(12) United States Patent
Park et al.

(10) Patent No.: US 8,329,430 B2
(45) Date of Patent: *Dec. 11, 2012

(54) POLYMYXIN SYNTHETASE AND GENE CLUSTER THEREOF

(75) Inventors: Seung-Hwan Park, Gongju-si (KR); Jihyun F Kim, Taejeon-si (KR); ChoongHwan Lee, Taejeon-si (KR); Soo-Keun Choi, Taejeon-si (KR); Heayoung Jeong, Taejeon-si (KR); Seong-Bin Kim, Taejeon-si (KR); Yon Kyoung Park, Taejeon (KR); Rumi Kim, Taejeon-si (KR); Choong-Min Ryu, Taejeon-si (KR); Soo-Young Park, Taejeon-si (KR)

(73) Assignee: Korea Research Institute of Bioscience and Biotechnology, Daejeon (KR)

( * ) Notice: Subject to any disclaimer, the term of this patent is extended or adjusted under 35 U.S.C. 154(b) by 166 days.

This patent is subject to a terminal disclaimer.

(21) Appl. No.: 12/728,039

(22) Filed: Mar. 19, 2010

(65) Prior Publication Data

US 2010/0279347 A1 Nov. 4, 2010

Related U.S. Application Data

(63) Continuation-in-part of application No. 12/096,789, filed as application No. PCT/KR2006/004665 on Nov. 8, 2006, now Pat. No. 7,811,790.

(30) Foreign Application Priority Data

Dec. 9, 2005 (KR) .................. 10-2005-0120878
Sep. 18, 2009 (KR) .................. 10-2009-0088575

(51) Int. Cl.
*C12P 21/06* (2006.01)
*C12N 1/20* (2006.01)
*C07H 21/04* (2006.01)

(52) U.S. Cl. ............... 435/69.1; 435/252.31; 435/320.1; 536/23.2

(58) Field of Classification Search ........................ None
See application file for complete search history.

(56) References Cited

U.S. PATENT DOCUMENTS 7,811,790 B2 * 10/2010 Park et al. ............ 435/69.1
2009/0226964 A1 9/2009 Park et al.

OTHER PUBLICATIONS

Beck et al. (2003) Novel pyrazine metabolites found in polymyxin biosynthesis by *Paenibacillus polymyxa*. FEMS Microbiology Letters, 220:67-73.
Paulus (1975) Polymyxin synthetase: L-2,4-diaminobutyrate activating enzyme. Methods Enzymol. 43:579-84.
Balakrishnan et al. (1980) Biosynthesis of polymyxin by *Bacillus polymyxa*. II. On the nature and interaction of the multienzyme complex with the end product polymyxin. Archives of Biochemistry and Biophysics. 200(1):45-54.
Komura et al. (1979) Partial purification and properties of L-2, 4-diaminobutyric acid activating enzyme from a polymyxin E producing organism. J. Biochem. 86:1013-1021.
Choi, et al., Identification of a Polymyxin Synthetase Gene Cluster of *Paenibacillus polymyxa* and Heterologous Expression of the Gene in *Bacillus subtilis*, Journal of Bacteriology, May 2009, pp. 3350-3358, vol. 191, No. 10, American Society for Microbiology.

* cited by examiner

*Primary Examiner* — Nashaat Nashed
(74) *Attorney, Agent, or Firm* — Greenlee Sullivan P.C.

(57) ABSTRACT

The present invention relates to a polymyxin synthetase isolated from Gram-positive *Paenibacillus* sp. and a gene cluster encoding the same, more precisely a polymyxin synthetase isolated from *Paenibacillus polymyxa* E681, ATCC21830 and F4 strains, a gene cluster encoding thereof and a preparation method of polymyxin or its derivatives using the gene cluster. The polymyxin synthetase of the present invention can be effectively used for the increase of productivity of polymyxin and the development of a novel antibiotic.

17 Claims, 14 Drawing Sheets

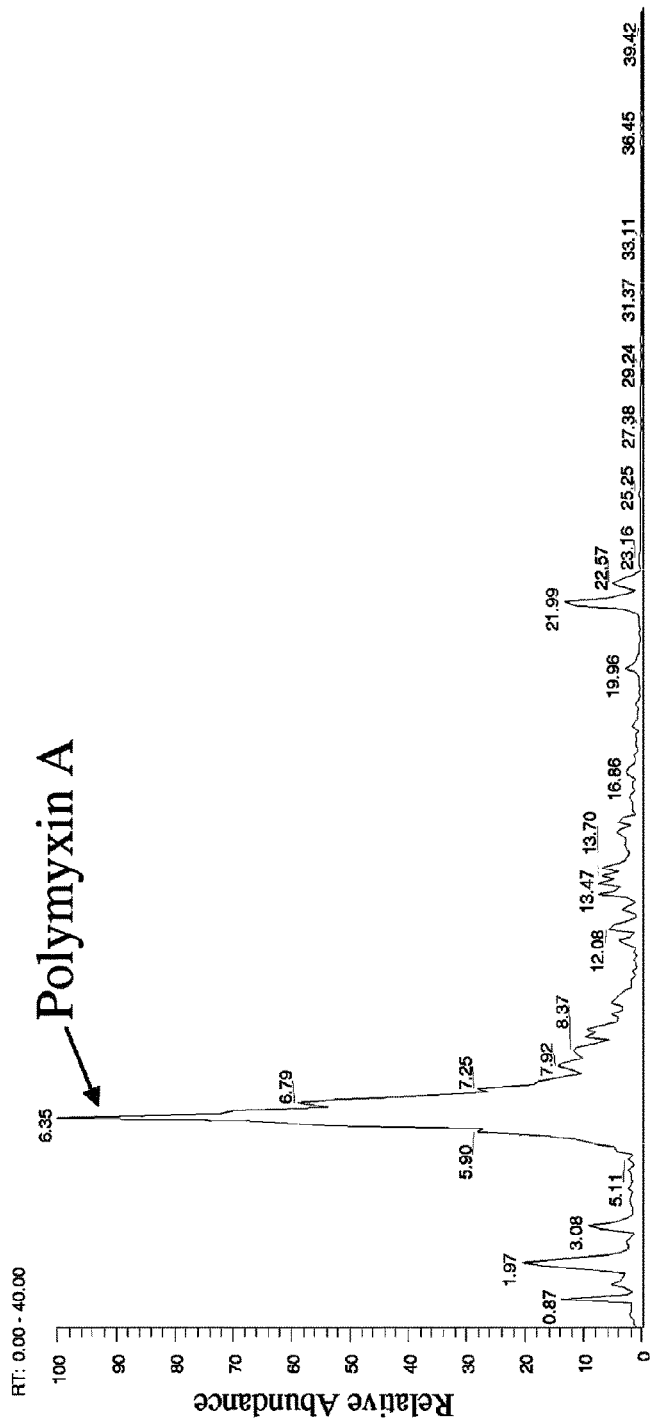
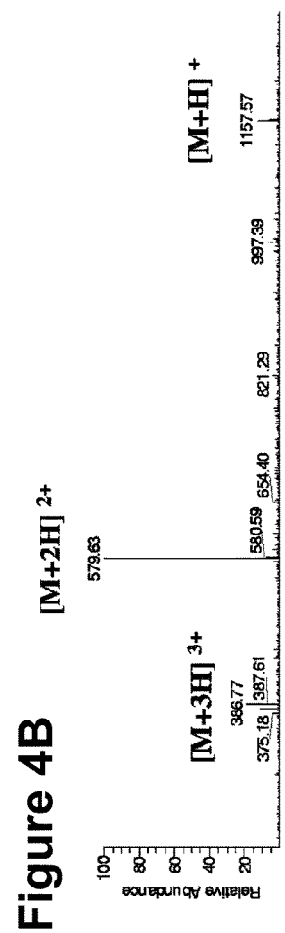
Figure 4A
Figure 4B

MOA: 6-methyloctanoyl residue
Dab: α,γ-Diaminobutyric acid residue

POLYMYXIN SYNTHETASE AND GENE CLUSTER THEREOF

CROSS-REFERENCE TO RELATED APPLICATIONS

This is a continuation-in-part of U.S. patent application Ser. No. 12/096,789, filed Jun. 9, 2008, which is the U.S. National Stage of International Application No. PCT/KR2006/004665, filed Nov. 8, 2006, which in turn claims priority to Korean Patent Application No. 2005-0120878, filed Dec. 9, 2005 and this application further claims priority to Korean Patent Application No. 2009-0088575, filed Sep. 18, 2009. The entire contents of which are hereby incorporated by reference.

TECHNICAL FIELD

The present invention relates to a polymyxin synthetase isolated from Gram-positive *Paenibacillus* sp., a gene cluster encoding thereof, and a preparation method of polymyxin or derivatives using the gene cluster.

BACKGROUND ART

Non-ribosomal peptide synthetase (referred as 'NRPS' hereinafter) is organized by at least one ORF (open reading frame) forming NRPS complex, and each NRPS or NRPS subunit comprises one or more modules. A module is defined as the catalytic unit that incorporates one building block (for example, one amino acid) into the growing chain. Order and specificity of the modules within the NRPS determine the sequence and structure of the peptide product. Thus, NRPS which is not involved in ribosomal RNA translation used to be carried out by genetic code can produce peptides of wider structural diversity than those peptides translated from RNA template by ribosome. The peptides produced by NRPS can be further modified by the connection between hydroxyl acid and D- and L-amino acid, mutation and oxidation in main peptide chain forming linear, cyclic or branched cyclic structure, acylation, glycosylation, N-methylation and heterocyclic ring formation.

Polymyxin synthetase, one of NRPSs, stepwisely combines each amino acid monomer forming polymyxin and if necessary transforms the amino acid to complete the entire amino acid chain and to form a ring structure in order to synthesize a peptide antibiotic. Each module of NRPS is organized by at least three domains, which are A, C, and T domains. A domain (adenylation domain) plays a role in the selection and activation of an amino acid monomer, C domain (condensation domain) catalyzes peptide bond formation and T domains (thiolation domain, also called peptidyl carrier protein, PCP) is responsible for transportation of substrates and elongation intermediates to the catalytic centers.

Recently, the tertiary structure of A domain recognizing phenylalanine of gramicidin biosynthesis gene has been identified, in which a specific amino acid binding site contains 8 amino acid residues (Conti, E. et al., *EMBO J.*, 16: 4174-4183, 1997). The amino acid sequence of this A domain was compared with that of the conventional A domain, as a result this A domain had high homology in 8 amino acid residues with the conventional A domain. Thus, analyzing the 8 amino acid residues may lead to the understanding of the association of a specific A domain with an amino acid (Challis, G. L. et al., *Chem. Biol.*, 7: 211-224, 2000).

In addition to these major domains, there are E domain (epimerization domain) playing a role in conversion of L-amino acid into D-amino acid and TE domain (termination domain), which are characterized by a specific amino acid motif.

A novel enzyme characterized by specificity can be designed by the modification of numbers and locations of modules at DNA level by genetic engineering and in vivo recombination techniques. For example, a domain originated from heterologous NRPS is substituted by using a recombinant technique (Schneider et al., *Mol. Gen. Genet.*, 257: 308-318, 1998) or a module can be designed to have specificity by changing residues forming the substrate binding pocket of A domain (Cane et al., *Chem. Biol.*, 6: 319-325, 1999).

Unlike other general peptides ribosomally translated, polymyxin is an antibiotic isolated from *Bacillus* sp. or *Paenibacillus* sp., which is produced by non-ribosomal peptide synthetase (Komura, S., and K. Kurahashi, *Biochem. Biophys. Res. Commun.* 95: 1145-1151, 1980; Martin, N. I. et al., *J. Biol. Chem.* 278: 13124-13132, 2003).

The molecular weight of polymyxin is approximately 1200 Da (1.2 kDa) (Storm, D. R. et al., *Ann. Rev. Biochem.*, 46: 723-763, 1977). The basic structure of polymyxin is a cyclic heptapeptide with a tripeptide side chain acylated by a fatty acid at the amino terminus. Normally, 6-methyloctanoic acid or 6-methylheptanoic acid is attached to the side chain (see FIG. 1). This structure favors solubility of polymyxin, suggesting that polymyxin is soluble in both water and an organic solvent.

Polymyxin is an antibiotic that is able to induce cell death by changing permeability of cell membrane and is functioning according to the following mechanisms.

First, the polycationic peptide ring of the polymyxin binds to the organisms by displacing the calcium and magnesium bridges that stabilize the lipopolysaccharide molecules. Then, lipopolysaccharide of cell membrane is interacted with fatty acid residue of polymyxin to facilitate further complexing between polymyxin and cell membrane. At last, polymyxin is inserted into the outer membrane of cell, resulting in the disruption of the cell membrane (Hermsen, E. D. et al., *Infect. Dis. Clin. N. Am.*, 17: 545-562, 2003).

Polymyxin B was first isolated from *Paenibacillus polymyxa* in 1947 and since then at least 15 polymyxins have been reported (Storm, D. R. et al., *Annu. Rev. Biochem.*, 46: 723-763, 1997; Silaev, A. B. et al., *Zh. Obshch. Khim.*, 45: 2331-2337, 1975; Martin, N. I. et al., *J. Biol. Chem.*, 278: 13124-13132, 2003). The polymyxin based antibiotic 'polymyxin B sulfate' killed 88% of *Pseudomonas aeruginosa* at the concentration of 0.01 µg/ml. Polymyxin E showed lethal effect at the concentration of 0.1 µg/ml. Polymyxin B and polymyxin E exhibited lethal effect on most *Escherichia coli* strains and *Pseudomonas aeruginosa* at the concentration under 2 µg/ml, in addition to on every *Enterobacter, Salmonella, Shigella, Pasteurella, Brucella* and *Bordetella*. However, both polymyxin B and E showed no lethal effect on *Proteus, Serratia, Providencia* and *Edwardsiella* even at the higher concentrations than 200 µg/ml. They had no effect on Gram-positive bacteria, fungi and anaerobic bacteria, either (Nord, N. M. et al., *N. Engl. J. Med.*, 270: 1030-1035, 1964).

Thus, polymyxin had been used as a therapeutic agent for many diseases caused by pathogenic microorganisms until early 1970. But, it carried serious side effects such as fever, skin eruption, and pain, and also induced severe nephrotoxicity and neurotoxicity (Hermsen, E. D. et al. Infect. Dis. Clin. North Am., 17:545-562, 2003; Pedersen, M. F. et al., *Invest. Urol.*, 9: 234-237, 1971). So, it has been replaced by other, better-tolerated antibiotics and recently it is mostly being applied on local wounds as a form of ointment.

According to the increased use of antibiotics, pathogenic microorganisms having resistance to those antibiotics have been frequently noticed. In the midst, polymyxin draws our attention since it has excellent bactericidal effect on Gram-negative bacteria, in particular *Pseudomonas aeruginosa* and *Acinetobacter baumannii* exhibiting resistance against β-lactam, aminoglycoside and fluoroquinolone antibiotics.

Levin et al. reported that colistin (polymyxin E) was intravenously injected to 60 patients infected with *Pseudomonas aeruginosa* and *Acinetobacter baumannii* exhibiting resistance against the conventional antibiotics and as a result 58% of the patients were improved (Levin, A. S. et al., *Clin. Infect. Dis.*, 28: 1008-1011, 1999). And there is another report by Stein et al. saying that 3 osteomyelitis patients infected with *Pseudomonas aeruginosa* having resistance against almost all antibiotics were improved by the treatment of colistin (Stein, A. et al., *Clin. Infect. Dis.*, 35: 901-902, 2002). In another report, meningitis caused by Acinetobacter having resistance against antibiotics was also successfully treated by colistin (Jimenez-Mejias, M. E. et al., *Eur. J. Clin. Microbiol. Infect. Dis.*, 21: 212-214, 2002). Another report says that ventriculis caused by antibiotics-resistant *Klebsiella pneumoniae* was successfully treated by polymyxin B (Segal-Maurer, S. et al., *Clin. Infect. Dis.*, 28: 1134-1138, 1999).

As described hereinbefore, polymyxin seems to have therapeutic effect on Gram-negative bacteria having resistance against the conventional antibiotics, so that it is in increasing demand.

It had been tried to introduce an antibiotic biosynthesis gene into an industrially mass-productive strain in order to increase antibiotic productivity (Eppelmann, K. et al., *J. Biol. Chem.*, 276: 34824-34831, 2001; Pfeifer, B. A. et al., *Microbiol. Mol. Biol. Rev.*, 65: 106-118, 2001) and in fact it was confirmed that the substitution of a promoter of the antibiotic biosynthesis gene with a stronger one resulted in the increase of productivity (Tsuge, K. et al., *J. Bacteriol.*, 183: 6265-6273, 2001). There is an attempt to develop a novel antibiotic by re-constructing modules or domains of an antibiotic biosynthesis gene (Mootz, H. D. et al., *Proc. Natl. Acad. Sci. USA*, 97: 5848-5853, 2000; Ferra, F. D. et al., *J. Biol. Chem.*, 272: 25304-25309, 1997) or substituting a specific amino acid of the domains (Eppelmann, K. et al., *Biochemistry*, 41: 9718-9726, 2002). However, no polymyxin biosynthesis gene has been identified so far, therefore it had hardly been tried to increase productivity or develop a novel antibiotic based on the above mentioned techniques.

Therefore, it is important to identify a polymyxin biosynthesis gene and secure the information on the gene to increase production of polymyxin or develop polymyxin with less side effects and polymyxin based novel antibiotics.

SUMMARY

It is an object of the present invention to provide a polymyxin synthetase isolated, a gene cluster encoding the enzyme, and a preparation method for polymyxin and its derivatives using the gene cluster.

The present invention provides an isolated gene cluster encoding a polymyxin synthetase comprising PmxA polypeptide subunit, PmxB polypeptide subunit and PmxE polypeptide subunit.

The present invention also provides an isolated polymyxin synthetase encoded by the gene cluster.

The present invention further provides a recombinant vector containing the gene cluster.

The present invention also provides a host cell transformed by the above vector.

The present invention also provides an amino acid additional module of the polymyxin synthetase, in which A-T-E, C-A-T, C-A-T-C, C-A-T-E, C-A-T-TE or A-T-TE domains are combined stepwisely.

The present invention also provides a gene encoding each amino acid additional module.

The present invention also provides a polymyxin synthetase produced by the combination of the amino acid additional modules.

And, the present invention provides a preparation method of polymyxin or its derivatives comprising the following steps:

1) Inserting a gene cluster encoding the polymyxin synthetase into an expression vector;
2) Transforming a host cell with the expression vector containing the gene cluster of step 1);
3) Culturing the transformant of step 2); and
4) Isolating and purifying polymyxin or its derivatives from the culture product of step 3).

DEFINITIONS

The descriptions for the terms used in the present invention are given hereinafter.

Non-ribosomal peptide synthetase (NRPS): composed of one or more ORFs (open reading frame) forming NRPS complex. Each NRPS or NRPS subunit contains one or more modules.

Module: a catalytic unit that incorporates a building block (ex: an amino acid) into the growing peptide chain. NRPSs produced peptides of enormous structural diversity, compared with ribosomally synthesized peptides.

Polymyxin: an antibiotic isolated from *Bacillus* sp. or *Paenibacillus* sp., which is generated by NRPS not by ribosomal synthesis after being encoded.

Polymyxin synthetase: one of NRPSs, which combines each amino acid monomer forming polymyxin stepwisely and modifies the amino acid to complete the entire amino acid chain and to form a ring structure to produce a peptide antibiotic. The present inventors found that the polymyxin synthetase composes of three subunits, PmxA, PmxB and PmxE which are translated separately, for the first time.

PmxA polypeptide subunit: one of subunits of polymyxin synthetase. The PmxA polypeptide subunit comprises four modules for adding the sixth to ninth amino acids respectively.

PmxB polypeptide subunit: one of subunits of polymyxin synthetase. The PmxB polypeptide subunit comprises a module for adding the last amino acid, L-threonine (L-Thr). The PmxB subunit has a termination domain, thus the carboxy terminus of the last amino acid is linked to the secondary amine of the fourth amino acid, L-2,4-diaminobutyric acid (L-Dab) by the termination domain.

PmxE polypeptide subunit: one of subunits of polymyxin synthetase. The PmxE polypeptide subunit comprises five modules for adding N-terminal five amino acids, respectively. The five amino acids are L-Dab, L-Thr, L-Dab, L-Dab and L-Dab, serially.

NRPS module: a part of polymyxin synthetase subunit adding an amino acid which comprising of A, C and T domains and optionally E and TE domains.

A domain (adenylation domain) plays a role in selection and activation of an amino acid monomer and C domain (condensation domain) catalyzes a peptide bond formation, while T domain (thiolation domain, also called peptidyl carrier protein, PCP) is responsible for transportation of substrates and elongation intermediates to the catalytic centers, E domain (epimerization) plays a role in conversion of L-amino acid into D-amino acid, and TE domain (termination domain) terminates the addition reaction of amino acids.

Deposition of Microorganisms

A recombinant *B. subtilis* BSK6 strain and a novel microorganism used herein, *Paenibacillus polymyxa* F4 strain were deposited at an International Depositary Authority, Korean Collection for Type Cultures (KCTC) located within Biological Resource Center (BRC) in the Korean Research Institute of Bioscience and Biotechnology, in compliance with the Budapest Treaty on the International Recognition of the Deposit of Microorganisms for the Purpose of Patent Procedure under Accession Number of KCTC11557BP on Sep. 18, 2009 and Accession Number of KCTC11667BP on Mar. 17, 2010, respectively.

The present inventors hereby assure the United States Patent and Trademark Office and the public that (a) all restrictions on the availability to the public of the above-identified deposited material will be irrevocably removed upon issuance of a United States patent of which any of such deposited material is the subject; (b) the deposited material will be maintained for a period of at least five years after the most recent request for the furnishing of a sample of any of the deposited material was received by the KCTC and, in any case, for a period of at least 30 years after the date of deposit or for the effective life of such patent, whichever is longer; (c) should any of the deposits become non-viable or mutated, or otherwise incapable of being furnished by the depository upon request due to the condition of the deposit, it will be replaced by Applicants; and (d) access to the cultures will be available to the Commissioner during the pendency of the patent application or to one determined by the Commissioner to be entitled to such cultures under 37 C.F.R. §1.14 and 35 U.S.C. §122.

DETAILED DESCRIPTION OF THE INVENTION

Hereinafter, the present invention is described in detail.

The present invention provides a gene cluster encoding polymyxin synthetase comprising PmxA polypeptide subunit, PmxB polypeptide subunit and PmxE polypeptide subunit. The gene cluster comprises a polynucleotide encoding the PmxA polypeptide subunit, a polynucleotide encoding the PmxB polypeptide subunit and a polynucleotide encoding the PmxE polypeptide subunit. The gene cluster optionally comprises a polynucleotide encoding PmxC and/or PmxD. Preferably, the polynucleotide encoding PmxC has the nucleotide sequence of SEQ ID NO: 19 and the polynucleotide encoding PmxD has the nucleotide sequence of SEQ ID NO: 20, but not limited thereto. In a preferred embodiment, the PmxC polypeptide has the amino acid sequence of SEQ ID NO: 21 and the PmxD polypeptide has the amino acid sequence of SEQ ID NO: 22, but not limited thereto. Although the PmxC and PmxD are not essential for the synthesis of polymyxin, the PmxC and PmxD are supposed to be related to polymyxin secretion. Thus, it is preferred to include the polynucleotides encoding PmxC and PmxD, respectively in the gene cluster when a heterologous expression system is used, but not limited thereto.

When the polymyxin is polymyxin A, the polynucleotide encoding the PmxA polypeptide subunit preferably has the polynucleotide sequence of SEQ ID NO: 1, but not limited, the polynucleotide encoding the PmxB polypeptide subunit preferably has the polynucleotide sequence of SEQ ID NO: 2 but not limited thereto, and the polynucleotide encoding the PmxE polypeptide subunit preferably has the polynucleotide sequence of SEQ ID NO: 3 but not limited thereto. When the polymyxin is polymyxin B, the polynucleotide encoding the PmxA polypeptide subunit preferably has the polynucleotide sequence of SEQ ID NO: 4 but not limited, the polynucleotide encoding the PmxB polypeptide subunit preferably has the polynucleotide sequence of SEQ ID NO: 5 but not limited thereto, and the polynucleotide encoding the PmxE polypeptide subunit preferably has the polynucleotide sequence of SEQ ID NO: 6 but not limited thereto. When the polymyxin is polymyxin E, the polynucleotide encoding the PmxA polypeptide subunit preferably has the polynucleotide sequence of SEQ ID NO: 7 but not limited, the polynucleotide encoding the PmxB polypeptide subunit preferably has the polynucleotide sequence of SEQ ID NO: 8 but not limited thereto, and the polynucleotide encoding the PmxE polypeptide subunit preferably has the polynucleotide sequence of SEQ ID NO: 9 but not limited thereto.

In a preferred embodiment, the gene cluster comprises $8194^{th}$ to $49233^{rd}$ nucleotide of SEQ ID NO: 109. In a more preferred embodiment, the gene cluster comprises the nucleotide sequence of SEQ ID NO: 109.

The gene cluster can be isolated any kind of microorganisms synthesizing polymyxin. However, it is preferred to be isolated from *Paenibacillus polymyxa* E681, when the polymyxin is polymyxin A, *Paenibacillus polymyxa* ATCC21830, when the polymyxin is polymyxin E, or *Paenibacillus polymyxa* F4, when the polymyxin is polymyxin B, but not limited thereto.

The polymyxin herein is preferably polymyxin A, B or E and more preferably polymyxin B or E having a cyclic heptapeptide with a tripeptide side chain, which comprises L-Dab (diaminobutyric acid), L-Thr (threonine) and L-Dab (or D-Dab), acylated by a fatty acid at the amino terminus. Normally, 6-methyloctanoic acid or 6-methylheptanoic acid is attached to the side chain. And the D-Phe (D-phenylalanine) or D-Leu (D-leucine) is located on the $6^{th}$, and the L-Leu, L-Thr or L-Ile (isoleucine) is located on the $7^{th}$ site of the polymyxins (see FIG. 1).

The present invention also provides an isolated polymyxin synthetase encoded by the gene cluster.

The polymyxin synthetase is one of NRPSs composed of one or more polypeptide subunits, which is encoded by a gene cluster. The "gene cluster" herein is defined as the genome segment of a microorganism containing all genes necessary for the synthesis of secondary metabolites.

Particularly, the polymyxin synthetase consists of PmxA polypeptide subunit, the PmxB polypeptide subunit and the PmxE polypeptide subunit. When the polymyxin synthesized thereby is polymyxin A, the PmxA polypeptide subunit preferably has the amino acid sequence of SEQ ID NO: 10, but not limited thereto, the PmxB polypeptide subunit preferably has the amino acid sequence of SEQ ID NO: 11, but not limited thereto, and the PmxE polypeptide subunit preferably has the amino acid sequence of SEQ ID NO: 12, but not limited thereto. When the polymyxin is polymyxin B, the PmxA polypeptide subunit preferably has the amino acid sequence of SEQ ID No: 13 but not limited thereto, the PmxB polypeptide subunit preferably has the amino acid sequence of SEQ ID NO: 14 but not limited thereto, and the PmxE polypeptide subunit preferably has the amino acid sequence of SEQ ID NO: 15 but not limited thereto. When the polymyxin is polymyxin E, the PmxA polypeptide subunit preferably has the amino acid sequence of SEQ ID No: 16 but not limited thereto, the PmxB polypeptide subunit preferably has the amino acid sequence of SEQ ID NO: 17 but not limited thereto, and the PmxE polypeptide subunit preferably has the amino acid sequence of SEQ ID NO: 18 but not limited thereto. The variants of the above polypeptides, which are polypeptides having functional identity even though there are addition, deletion or substitution of one or more modules, domains and/or amino acids, can also be included.

The present inventors sequenced the nucleotide sequence of *Paenibacillus polymyxa* E681 genome by using whole-genome shotgun sequencing strategy. As a result, it was confirmed that *Paenibacillus polymyxa* E681 genome is approximately 5.4 Mbps in length and has a single circular chromosome. The present inventors also identified a polymyxin synthetase gene cluster from the genome above.

Approximately 4800 genes encoding proteins have been identified from the nucleotide sequence of E681 genome by using Critica (Badger, J. H. and Olsen, G. *J., Mol. Biol. Evol.*, 16: 512-524, 1999), glimmer (Delcher, A. L. et al., *Nucleic Acids Res.*, 27: 4636-4641, 1999) and zcurve (Guo, F.-B. et al., *Nucleic Acids Res.*, 31: 1780-1789, 2003) programs. To investigate the functions of each gene product, the genes were translated into amino acid sequences and compared with sequences in the protein sequence database (Altschul, S. F. et al., *Nucleic Acids Res.*, 25: 3389-3402, 1997). Next, domain and protein family analysis (Bateman, A. et al., *Nucleic Acids Res.*, 32 (Database issue): D138-141, 2004; Haft, D. H. et al., *Nucleic Acids Res.*, 31: 371-373, 2003), motif and pattern screening (Hulo, N. et al., *Nucleic Acids Res.* 32 (Database issue): D134-137, 2004) and protein site prediction analysis (Gardy, J. L. et al., *Nucleic Acids Res.*, 31: 3613-3617, 2003) were performed.

From the above screening, at least 4 NRPS gene clusters encoding 4 different antibiotic synthetases have been identified.

The substrate specificity of adenylation (A) domain of each gene cluster was compared with the chart showing active amino acids associated with A domain substrate specificity prepared by Challis et al. (Challis, G. L. et al., *Chem. Biol.* 7: 211-224, 2000). As a result, one of the gene clusters was identified as the gene cluster encoding polymyxin synthetase (see FIG. 2).

Each polypeptide of the polymyxin synthetase of the present invention contains one or more modules and each module is preferably organized by at least 2 domains selected from a group consisting of A, C, T, E and TE domains.

In polymyxin synthetase composed of PmxA, PmxB and PmxE, C domain of the fifth module of PmxE joins in the first module 'A-T-E' of PmxA, and the last C domain of the forth module of PmxA joins A-T-TE of PmxB. PmxC and PmxD were proved not to be involved in polymyxin synthesis but expected to be involved in polymyxin secretion.

Polymyxin is synthesized by completing a heptapeptide ring by the stepwise binding of L-Dab (2',4'-diaminobutyric acid), L-Thr (threonine), L-Dab (or D-Dab), L-Dab, and L-Dab to the 6-MOA (methyloctanoyl acid) by PmxE polypeptide subunit and locating D-Phe (D-phenylalanine) or D-Leu (D-leucine) on the $6^{th}$ site and then locating L-Leu, L-Thr or L-Ile (isoleucine) on the $7^{th}$ site, followed by the stepwise binding of L-Dab and L-Dab by PmxA polypeptide subunit, and at last linking L-Thr by PmxB polypeptide subunit (see FIG. 1(A)).

The present inventors assumed that the polymyxin synthetase identified from *Paenibacillus polymyxa* E681 is polymyxin A synthetase through domain analysis, because the third module of PmxE has an epimerization domain and thus it is predicted that D-Dab is incorporated at the third position instead of L-Dab. In order to confirm whether the polymyxin synthetase synthesize polymyxin A, the present inventors constructed a pmxE knockout mutant of *Paenibacillus polymyxa* E681 and a transformed *Bacillus subtilis* comprising a whole pmxABCDE gene cluster. The whole pmxABCDE gene cluster was integrated into the genome of host *Bacillus subtilis* strain (see FIG. 8). The recombinant *B. subtilis* BSK6 strain was deposited at Korean Collection for Type Cultures (KCTC) located within Biological Resource Center (BRC) in the Korean Research Institute of Bioscience and Biotechnology (KRIBB) under Accession Number of KCTC11557BP on Sep. 18, 2009. The present inventors confirmed that there is no polymyxin A in pmxE mutant and identified polymyxin A from supernatant of the transformed *Bacillus subtilis* strain grown in medium containing Dab using liquid chromatography (LC) and mass spectrometry (MS) analysis (see FIG. 10).

The present inventors cloned gene clusters encoding polymyxin synthetase from other *Paenibacillus polymyxa* strains in order to confirm whether the structures of the gene cluster and polymyxin synthetase is conserved. Particularly, the present inventors cloned pmxABCDE gene cluster from *Paenibacillus polymyxa* ATCC21830 strain (hereinafter referred as "ATCC21830 strain") which was known to synthesize polymyxin E (Koyama, Y. et al., *J. Antibiot.*, 3: 457-458, 1950) and *Paenibacillus polymyxa* F4 (hereinafter referred as "F4 strain") which was isolated in the present invention and analyzed to synthesize polymyxin B and analyzed gene structures thereof. The F4 strain was deposited at an International Depositary Authority, Korean Collection for Type Cultures (KCTC) located within Biological Resource Center (BRC) in the Korean Research Institute of Bioscience and Biotechnology, in compliance with the Budapest Treaty on the International Recognition of the Deposit of Microorganisms for the Purpose of Patent Procedure under Accession Number of KCTC11667BP on Mar. 17, 2010. Through a series of genetic analyses, the present inventors identified the structures of polymyxin synthetases and confirmed that gene clusters encoding the polymyxin synthetase of three strains are same.

The polymyxin synthetases predicted by the nucleotide sequence of the gene clusters as shown in FIG. 13, enabled the prediction of polymyxin A, polymyxin B, and polymyxin E.

A novel polymyxin synthetase having a different specificity can be derived from the gene cluster of the present invention by genetic alteration such as changing number or position of a module or a domain in the gene cluster. For example, heterologous NRPS originated domain was substituted (Schneider et al., *Mol. Gen. Genet.*, 257: 308-318, 1998) or a residue forming substrate binding pocket of A domain was replaced to design a novel substrate specificity (Cane and Walsh, *Chem. Biol.*, 6: 319-325, 1999), or structural modification was performed by addition, substitution or deletion of one or more modules, domains or amino acids or by the linkage between D- and L-amino acid and hydroxyl acid, mutation and oxidation of peptide chain, acylation, glycosylation, N-methylation and heterocyclic ring formation.

Therefore, the gene provided by the present invention can be effectively used for the development of polymyxin with minimized side effects and its derivatives or a novel antibiotic according to the above method.

The present invention also provides a recombinant vector containing the gene cluster of the invention and a host cell transformed with the vector.

The gene cluster encoding polymyxin synthetase of the invention can be cloned into such vectors as BAC, plasmid, and fosmid, and the vector can be introduced into a relevant host cell to produce a polymyxin antibiotic.

In the present invention, *Paenibacillus polymyxa*, *E. coli*, and *Bacillus subtilis* are preferably used as host cells. A recombinant vector can be introduced into such host cells by a conventional method well-known to those in the art including heat-shock method or electric-shock method. It is also well understood to those in the art that different strains can be used as host cells according to the purpose of expression or various vectors.

The present inventors constructed a transformed *Bacillus subtilis* strain whose genome comprises the gene cluster encoding the polymyxin synthetase as described above (see FIG. 8) and confirmed a heterologous production of polymyxin from the transformed *Bacillus subtilis* strain, while wild type *Bacillus* does not produce polymyxin (see FIG. 9).

The present invention also provides an amino acid additional module of polymyxin synthetase A-T-E, C-A-T, C-A-T-C, C-A-T-E C-A-T-TE or A-T-TE and a gene encoding each of the amino acid additional modules.

Each module forming a polypeptide is described herein. First, Pmx A polypeptide is organized by the following 4 modules, The first module: A (adenylation)-T (thiolation)-E (epimerization) domain;

The second module and the third modules: C (condensation)-A-T domain; and

The forth module: C-A-T-C domain.

Pmx B polypeptide comprises one module which is A-T-TE (termination) domain,

And Pmx E polypeptide is organized by the following 5 modules,

The first and the second modules: C-A-T domain;

The third module: C-A-T or C-A-T-E domain;

The forth module: C-A-T domain; and

The fifth module: C-A-T-C domain (see FIG. 3).

Polynucleotides encoding each domain and module of PmxA, PmxB and PmxE are those represented by SEQ ID NO: 19~NO: 78, in which linker genes combining each domain are also included. The SEQ ID NOs of each domain is presented in Table 1.

The present invention also provides a polymyxin synthetase produced by the combination of the amino acid additional modules.

Each polymyxin synthetase is formed by the combination of modules arranged as A-T-E, C-A-T, C-A-T-C, C-A-T-E, C-A-T-TE or A-T-TE. Therefore, the construction of such recombinant expression vector that contains the combination of polynucleotide encoding each module leads to the diversity of polymyxin synthetases.

The present invention also provides a preparation method of polymyxin or its derivatives comprising the following steps:

1) inserting a gene cluster encoding the polymyxin synthetase into an expression vector;
2) transforming a host cell with the expression vector containing the gene cluster of step 1);
3) culturing the transformant of step 2); and
4) isolating and purifying polymyxin or its derivatives from the culture product of step 3).

DESCRIPTION OF DRAWINGS

The application of the preferred embodiments of the present invention is best understood with reference to the accompanying drawings, wherein:

FIG. 1 illustrates the structure of polymyxin.

FIGS. 4A and 4B are a series of graphs showing LC analysis of culture supernatants of *P. polymyxa* E681 strain (FIG. 4A) and MS data for polymyxin A produced by the same (FIG.4B)

EXAMPLES

Figure 1A:
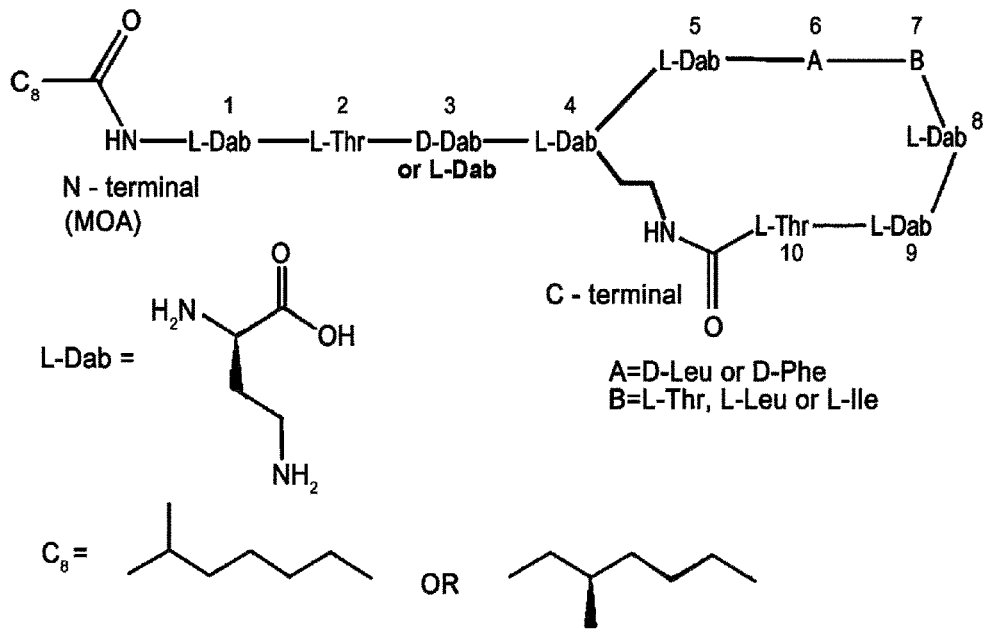
FIG. 1(A) is a representative diagram of polymyxin and FIG. 1(B) illustrates the structure of polymyxin A isolated from *Paenibacillus polymyxa* E681.
Figure 1B:
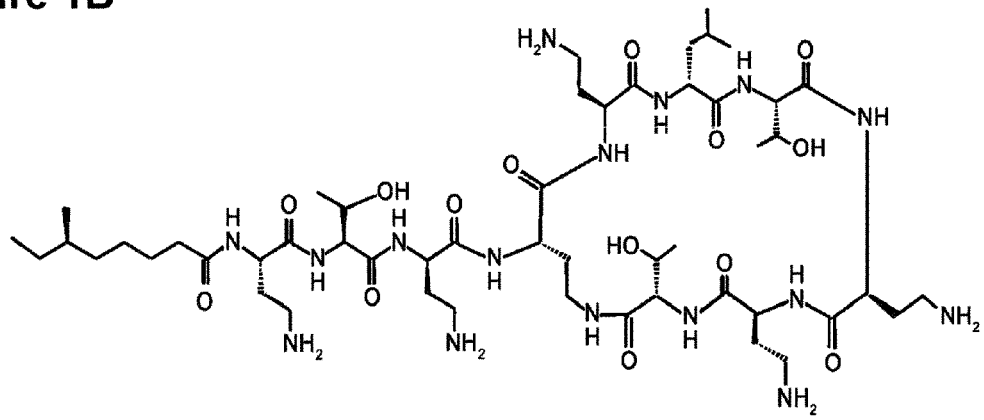

Practical and presently preferred embodiments of the present invention are illustrative as shown in the following Examples.

However, it will be appreciated that those skilled in the art, on consideration of this disclosure, may make modifications and improvements within the spirit and scope of the present invention.

Example 1

Isolation and Analysis of Polymyxin from *Paenibacillus polymyxa* E681

<1-1> Culture of *Paenibacillus polymyxa* E681

*Paenibacillus polymyxa* E681 was cultured in the medium designed by Paulus and Gray (Paulus H and Gray E., *J. Biol.*

Chem., 239: 865-871, 1964) under aerobic condition at with 180 rpm for 3 days, followed by centrifugation (7000 rpm, 10 min) to separate supernatant.

<1-2> Identification of polymyxin by LC/MS analyzing system

The composition of the supernatant was analyzed by LC/MS system.

LC/MS was performed using high pressure liquid chromatography system provided by Thermo Electron Co. (USA) and ion spectrometer. The sample proceeded to reversed-phase column (YMC Hydrosphere C18 column) and analyzed in a mixed solvent of acetonitrile and water containing 0.1% formic acid (0.2 Ml/min).

As a result, $(M+H)^+$ ion peak was 1158, and the actual molecular weight was confirmed to be 1157, which is the same molecular weight of the conventional polymyxin A or M (polymyxin M is different from polymyxin A in that the $3^{rd}$ amino acid is L-Dab, whereas polymyxin A has D-Dab on the same position).

To confirm whether the target compound was polymyxin A or M, acetylation was performed. Particularly, the target compound was treated with pyridine:acetic anhydride (1:1), followed by reaction for 12 hours at room temperature. The molecular weight of the target compound was measured by LC/MS. As a result, it was confirmed that the target compound had the molecular weight of 1493, which was the same weight as that Martin et al. (Martin et al., *J. Biol. Chem.*, 278: 13124-13132, 2003) reported earlier (FIG. 4).

Example 2

Sequencing of Polymyxin Biosynthesis Gene

The nucleotide sequence of *Paenibacillus polymyxa* E681 genome was completely sequenced by whole-genome shotgun sequencing strategy and then the polymyxin synthetase gene cluster was identified.

<2-1> Library Construction

*Paenibacillus polymyxa* E681 was cultured by the same manner as described in Example 1, and chromosomal DNA was extracted by the method described in Genome Analysis, A laboratory manual Vol. III Cloning systems (CSHL Press, Cold Spring Harbor, N.Y., USA), and the DNA was fragmented to construct a shotgun library for sequencing.

The high molecular chromosomal DNA fragmentation was performed with VCX-500 ultrasonicator (Sonics, Newtown, Conn., USA) with 19% strength, 0.3/3 sec of pulse on/off time, 6 times. The DNA fragments of 2 kb, 5 kb, 8 kb and 10 kb in size were recovered and used to construct the library. pUC18, pUC19, pUC118 or pBCKS (Stratagene, La Jolla, Calif., USA), and pTrueBlue (Genomics One (Laval, Quebec, Canada) vectors were used. The DNAs of ~40 kb and ~100 kb in size were used to construct fosmid library and BAC library, which would be used for forming the contig structure.

The fosmid library was constructed by using a fosmid library production kit (CopyControl™ fosmid library production kit, Epicentre Biotechnologies, Madison, Wis., USA) and the BAC library was constructed by inserting the chromosomal DNA digested with HindIII into pIndigo 536 vector (Peterson, D. G. et al., 2000, *J. Agric. Genomics*, 5: www.ncgr.org/research/jag, Luo M. et al., 2001, Genome 44: 154-162, 2001).

The reactant for the plasmid library was inserted into *E. coli* DH10B by electroporation, which was smeared on a LB agar plate medium containing X-gal/IPTG/Amp (Ampicillin). White recombinant colony was inoculated to a 96 deep-well plate containing LB(Amp) liquid medium, followed by shaking-culture in a 37 incubator with 250 rpm for 48 hours. Cells were recovered and plasmid DNA was separated and purified according to the standard method.

<2-2> Nucleotide Sequence Analysis

DNA sequencing was performed by using BigDye™ terminator cycle sequencing kit (Applied Biosystems, Calif., USA) and the reactant was analyzed with ABI 3700 and 3730 DNA analyzer (Applied Biosystems, Foster City, Calif., USA). Files containing the results were analyzed with phred/phrap/consed program (//www.phrap.org). All the result files were analyzed with phred to organize nucleotide sequences and relevant results were collected to mask the sequence of the vector. Sequence combining was carried out by phrap and contig confirmation and edition and primer design were carried out by consed.

Approximately 61,700 sequence fragments (6.7 times) were obtained from the termini of the plasmid and fosmid/BAC, followed by sequencing combining. As a result, approximately 800 contig sequences were obtained, followed by finishing.

Clones connecting contigs by the sequences of the both ends were screened and then a primer was designed to read the gap between sequences, followed by determination of the nucleotide sequence. Only those fosmids connecting a big part having the gap of at least 15 kb were selected, followed by limited shotgun sequencing. The incorrectly combined sequence by repetitive sequences such as rRNA gene or transferase gene was corrected by using consed program. To remove physical gaps, primers were designed based on the end of each contig, followed by recombinant PCR or RT-PCR to obtain the sequences of the unknown region. All the gaps were eliminated to prepare authentic circular chromosome sequence, and Phred was operated. PCR was performed again to amplify the uncertain region. The aim of the accuracy was >99.99% (up to 1 by error per 10 kb).

The whole nucleotide sequence of the identified *Paenibacillus polymyxa* E681 genome was approximately 5.4 Mbps in total length and had the single circular chromosome structure (% G+C: 45.8).

<2-3> Prediction of a Protein from a Gene

Approximately 4800 protein encoding genes were identified from the genome by running Critica (Badger, J. H. and Olsen, G. J., 1999, Mol. Biol. Evol. 16, 512), glimmer (Delcher, A. L. et al., *Nucleic Acids Res.*, 27: 4636-4641, 1999) and zcurve (Guo, F.-B. et al., *Nucleic Acids Res.*, 31: 1780-1789, 2003). To investigate the functions of each gene product, those genes were translated into amino acid sequences, which were screened by blastp with the known protein sequence databases (Altschul, S. F. et al., *Nucleic Acids Res.*, 25: 3389-3402, 1997). At this time, the databases used were COG (Tatusov R. L. et al., *BMC Bioinformatics*, 4: 41, 2003), UniProt Knowledgebase (Bairoch A. et al., *Nucleic Acids Res.*, 33(Database issue): D154-159, 2003), NCBI-NR (//ftp.ncbi.nih.gov/blast/db/nr.tar.gz) and KEGG-Genes (Kanehisa, M. et al., *Nucleic Acids Res.*, 32(Database issue): D277-280, 2004). For the analysis of a domain and a protein family, Pfam (Bateman, A. et al., *Nucleic Acids Res.*, 32(Database issue): D138-141, 2004) and TIGRFAMs (Haft, D. H. et al., *Nucleic Acids Res.*, 31: 371-373, 2003) databases were used. For the investigation of a motif and a pattern, Prosite (Hulo, N. et al., *Nucleic Acids Res.*, 32(Database issue): D134-137, 2004) database was used.

Psort-B was used to predict the location of a protein (Gardy, J. L. et al., *Nucleic Acids Res.*, 31: 3613-3617, 2003). The proteins were given hierarchical names considering liability of the screening results. The protein had no homologs having E-value of lower than $10^{-5}$ from UniProt screening was named hypothetical protein.

Figure 2:
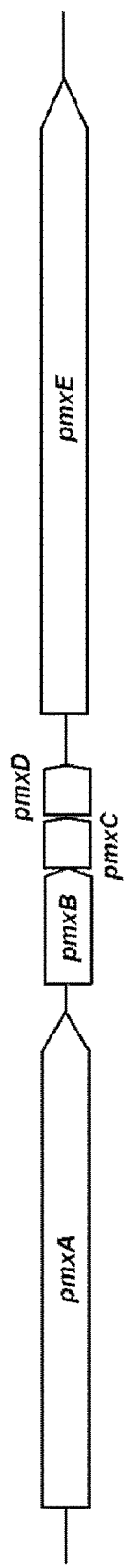
FIG. 2 is a diagram illustrating the structure of a polymyxin synthetase gene cluster originated from *Paenibacillus polymyxa* E681.

From the analysis of genome information, at least 4 NRPS gene clusters encoding 4 different antibiotic synthetases have been identified. The substrate specificity of A domain of each gene cluster was compared with the substrate specificity associated active amino acid chart made by Challis et al. (Challis, G. L. et al., *Chem. Biol.*, 7: 211-224, 2000). As a result, one of them was identified as the gene cluster encoding polymyxin synthetase (FIG. 2). As shown in FIG. 2, the gene cluster encoding polymyxin synthetase comprises pmxA, pmxB, pmxC, pmxD and pmxE. Among them, pmxA, pmxB and pmxE were supposed to encode polymyxin synthetase, because the three genes have module for adding amino acids shown in NRPSs commonly. After ORF analysis, it was confirmed that pmxA gene consists of the nucleotide sequence of SEQ ID NO: 1, pmxB gene consists of the nucleotide sequence of SEQ ID NO: 2 and pmxE gene consists of the nucleotides sequence of SEQ ID NO: 3 and the amino acid sequences of polypeptides encoded thereby are SEQ ID NOs: 10 to 12, respectively. Further, nucleotide sequences and corresponding amino acid sequences of pmxC gene and pmxD gene were determined. Particularly, pmxC gene consists of the nucleotide sequence of SEQ ID NO: 19 and pmxD gene consists of the nucleotide sequence of SEQ ID NO: 20 and the amino acid sequence of corresponding polypeptides encoded thereby are SEQ ID NOs: 21 and 22.

Example 3

Figure 3:
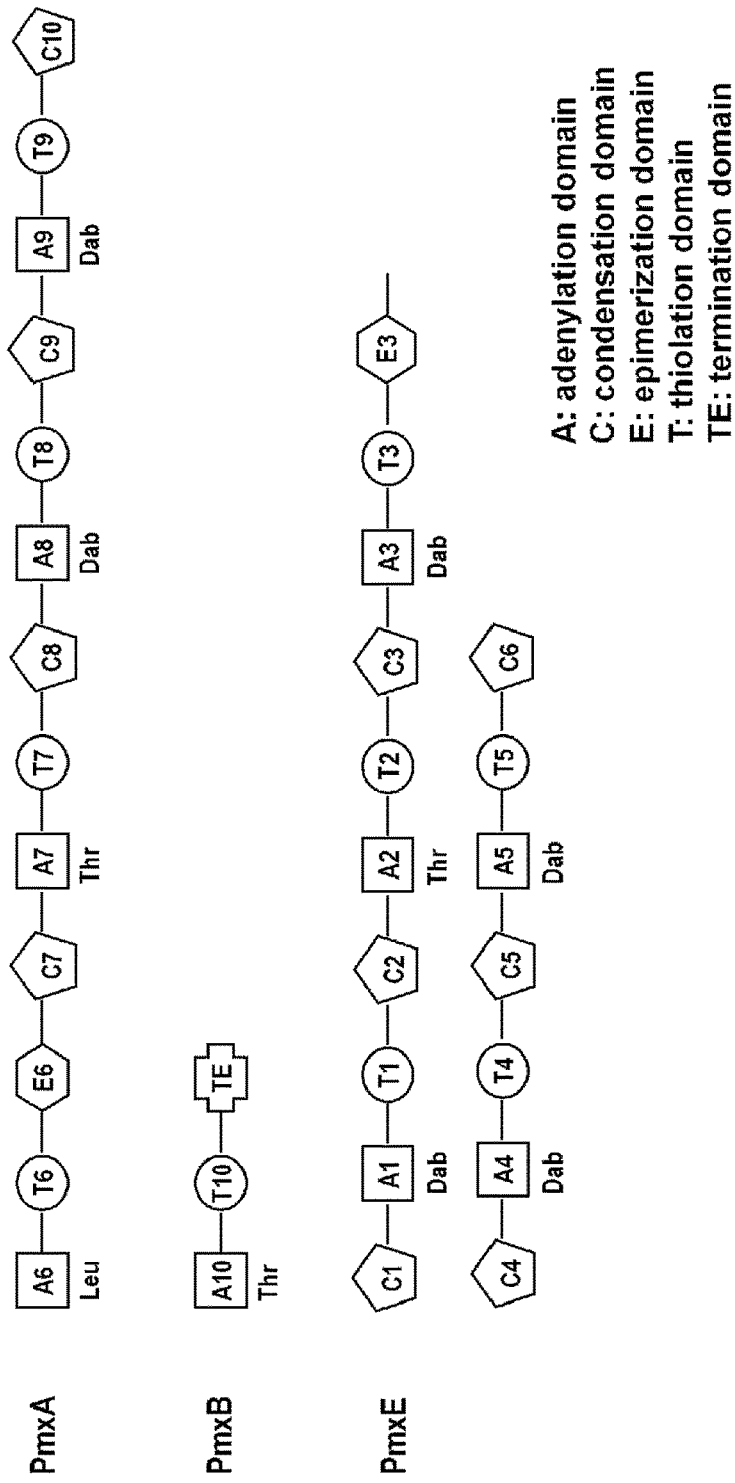
FIG. 3 is a diagram illustrating the structure of the domain of a polymyxin synthetase gene originated from *Paenibacillus polymyxa* E681 genome, A: Domain A (adenylation);
C: Domain C (condensation);
E: Domain E (epimerization);
T: Domain T (thiolation); and
TE: Domain TE (termination)

Prediction of Polymyxin Structure from the Nucleotide Sequence of Polymyxin Biosynthesis Gene The polymyxin biosynthesis gene of the present invention was analyzed based on the chart showing the substrate specificity associated active amino acids summarized by Challis et al. (Challis, G. L. et al., *Chem. Biol.*, 7: 211-224, 2000). As a result, the gene was confirmed to be organized by such domains as pmxA, pmxB and pmxE, as shown in FIG. 3. Each A domain recognized amino acids such as DAB, Leu and Thr. The amino acid sequence of each domain was determined and the SEQ ID NOs corresponding to each domain is shown in Table 1.

TABLE 1

Sequence List of domains of each polypeptide subunit

| Domain | Module | | |
|---|---|---|---|
| | PmxA | PmxB | PmxE |
| A | 24, 31, 36, 42 | 48 | 55, 60, 66, 73, 78 |
| T | 26, 33, 38, 44 | 50 | 57, 62, 68, 75, 80 |
| C | 30, 35, 40, 46 | | 54, 59, 64, 72, 77, 82 |
| E | 28 | | 70 |
| TE | | 52 | |

Figure 5:
FIG. 5 is a diagram illustrating the structure of polymyxin predicted from the domain structure of polymyxin synthetase gene separated from *Paenibacillus polymyxa* E681 genome and other polymyxins.

As shown in FIG. 5, the predicted polymyxin was confirmed to be polymyxin A, since there is an E domain in the $3^{rd}$ module of PmxE.

Example 4

Constructing a pmxE Mutant

The present inventors constructed a pmxE mutant in order to confirm whether the gene cluster identified above encodes polymyxin synthetase indeed.

The PCR primers used are listed in Table 2. A deletion mutant of the pmxE gene was constructed using an *E. coli* fosmid clone. In brief, a fosmid DNA (PP12G04) harboring truncated pmxA and complete pmxB, pmxC, pmxD, and pmxE in a 38.1-kbp chromosomal DNA fragment cloned into pCC1fos (Epicentre Biotechnologies) was introduced into *E. coli* BW25113 carrying the Red recombinase expression plasmid, pKD46 (Datsenko, K. A. and B. L. Wanner., *Proc. Natl. Acad. Sci. USA*, 97: 6640-6645, 2000). The chloramphenicol acetyltransferase (cat) gene of fosmid PP12G04 was replaced with a tetracycline resistance gene (Tc) using a λ Red recombination system to construct fosmid pPmx-Tc. The Tc gene was amplified from pBC16 (Bernhard et al., *J. Bacteriol.*, 133: 897-903, 1978) with the Foscm-TCF and Foscm-TCR primers bearing 70-bp side arms that bind to the flanking regions of the cat gene of pCC1fos. For inactivation of the pmxE gene, a chloramphenicol resistance gene-kanamycin resistance gene (cat-kan) cassette was introduced into the pmxE structural gene of pPmx-Tc using a λ Red recombination system. The cat-kan cassette was constructed as follows. The cat gene was amplified by PCR with primers CatF and CatR from pDG1661 (Guérout-Fleuryet et al., Gene, 180: 57-61, 1996) and was then introduced into pGem7zf(+) (Invitrogen Inc.) with EcoRI and BamHI cleavage sites. The resulting plasmid was digested with the NarI restriction enzyme and was then ligated with the PCR product containing the kanamycin resistance gene that was amplified from pKD4 (Datsenko, K. A. and B. L. Wanner., *Proc. Natl. Acad. Sci. USA*, 97: 6640-6645, 2000) by using the Kd4kanF and Kd4kanR primer set. The constructed cat-kan cassette was amplified with primers PmxEckF and PmxEckR, yielding 60-bp homologous arms of the target site to each of the ends. The amplified cat-kan cassette was inserted into pPmx-Tc to construct the pDpmxE fosmid. To remove the pKD46 plasmid completely, kanamycin-resistant transformants were transferred onto fresh agar medium containing kanamycin and were subsequently incubated at 37° C. The disruption of pmxE with the cat-kan cassette was confirmed by PCR with primers pmxEdelF and pmxEdelR, which bind to the outer regions of the homologous arm. The pDpmxE fosmid was introduced into *P. polymyxa* E681 to generate a polymyxin-defective mutant. The mutant was also confirmed by PCR using the pmxEdelF and pmxEdelR primers. Transformation of *P. polymyxa* was performed according to a previously reported method (Choi et al., *Biochem. Biophys. Res. Commun.*, 365: 89-95, 2008).

TABLE 2

Primers used for generating a pmxE mutant

| Primers | Nucleotide Sequences (5' to 3') | SEQ ID NOs |
|---|---|---|
| Foscm-TCF | TATCGAGATTTTCAGGAGCTAAGGAAGCTAAAAT GGAGAAAAAAATCACTGGATATACCACCGTTGAT AGATACAAGAGAGGTCTCTCG | 83 |
| Foscm-TCR | GGCACCAATAACTGCCTTAAAAAAATTACGCCCC GCCCTGCCACTCATCGCAGTACTGTTGTAATTCA TAACAAACGGGCCATATTGTTG | 84 |
| CatF | AAAGGATCCTCATGTTTGACAGCTTATCATCG | 85 |
| CatR | AAAGAATTCCCACGCCGAAACAAGCGCTC | 86 |
| Kd4kanF | CCATCGATGTGTAGGCTGGAGCTGCTTC | 87 |
| Kd4kanR | CCATCGATATGGGAATTAGCCATGGTCC | 88 |

TABLE 2-continued

Primers used for generating a pmxE mutant

| Primers | Nucleotide Sequences (5' to 3') | SEQ ID NOs |
|---|---|---|
| PmxEckF | GCATTCAATAACAAAGATTATGCCGTTTGGCAGC ATTCCCGAAGCTTACGGGCAGATGCTCCAGCCGC AGAATCATGTTTGACAGCTTATCATCG | 89 |
| PmxEckR | GCAGCACGTCCATGGAAAGGCCGTCGGAACCAAT ATGATGAATATCCAGCGCGAGCAGAAATTTCTCT TTCCACGCCGAAACAAGCGCTC | 90 |
| PmxEdelF | GTCTCGGATGGCATTTCGACAG | 91 |
| PmxEdelR | AGAAGTCGAGAGGCAGCTCAAG | 92 |

Figure 6:
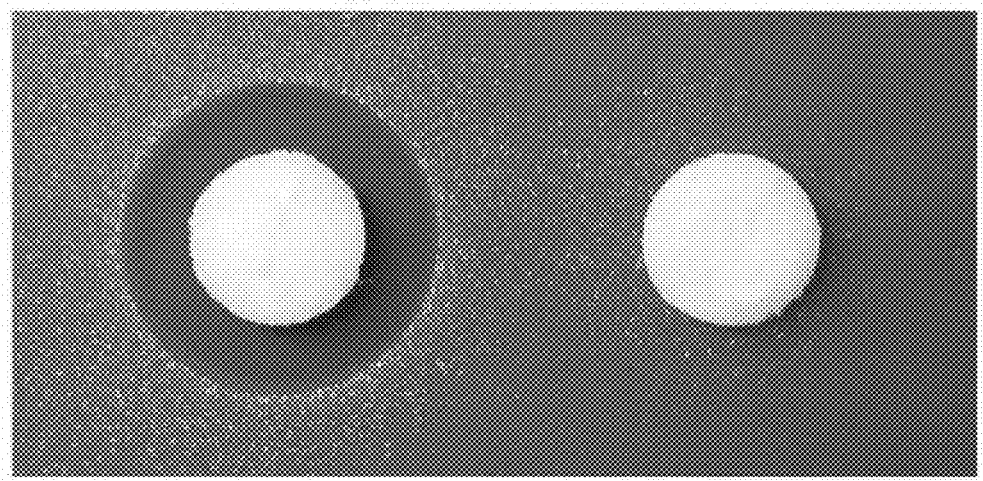
FIG. 6 is a photograph showing antibacterial activities of the culture supernatants of wild-type E681 and the pmxE mutant strains against *E. coli* DH5α.
Figure 7:
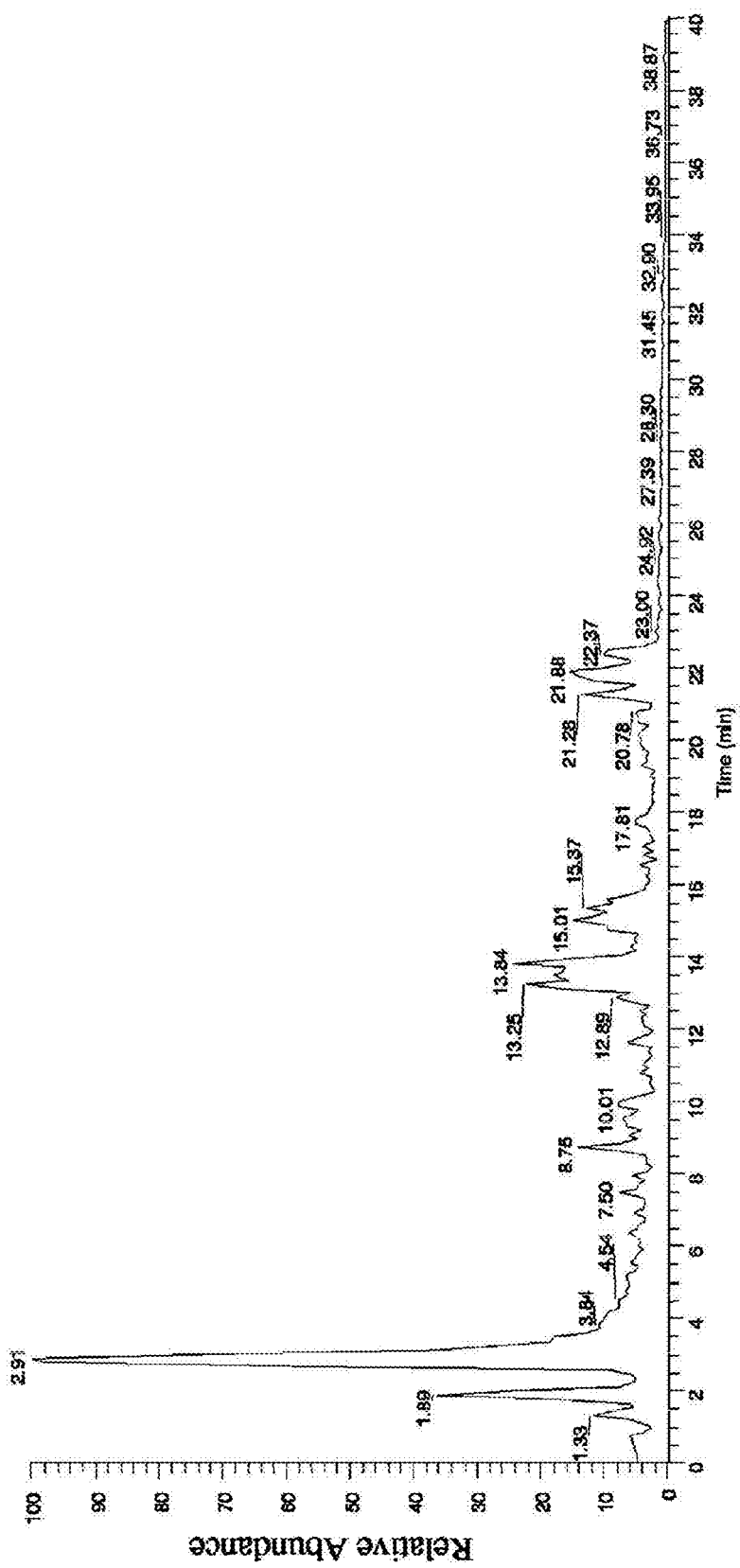
FIG. 7 is a graph showing LC analysis of culture supernatants of pmxE mutant.

As a result, the antibacterial activity of the pmxE mutant of *P. polymyxa* E681 was completely abolished in a bioassay against *E. coli* (FIG. 6). LC/MS data supported our earlier results by showing that the peak corresponding to polymyxin could not be detected in the pmxE mutant (FIG. 7). Taken together, these results demonstrated that the pmx gene cluster is essential for polymyxin biosynthesis.

Example 5

Heterologous Expression of the pmx Gene Cluster in *B. subtilis*

<5-1> Construction of Transformed *B. subtilis*

For the efficient transformation of the *Bacillus* host strain with large DNA fragments, the genes responsible for BsuM restriction and modification (RM) (Haima et al., *Mol. Gen. Genet.*, 209: 335-342, 1987) were removed from *B. subtilis* 168 as follows. Primers used for constructing transformed *B. subtilis* are listed in Table 3.

TABLE 3

Primers used for constructing transformed *B. subtilis*

| Primers | Nucleotide Sequences (5' -> 3') | SEQ ID NOs |
|---|---|---|
| ydiO-up-F | TAATGAGTTAGATGAAATACC | 93 |
| ydiO-up-R | TTT*GGATCC*TTATCATTCCTAGTATTACAC | 94 |
| ydjA-down-F | TTT*GGATCC*TGTTATTAGTCGGAATGAATG | 95 |
| ydjA-down-R | TAT*CTGCAG*GAATAAACAGAAAGGAAAGACTG | 96 |
| 1730-12DF | ACTGCATGTCCCCAGTGCATCGGTCCCCATAC GGATTTATACGGGTAATGTTGATAGAACAAGT GATATTGGTATGTTTCTCTTTGATGTC | 97 |
| 1730-12DR | AGATTATCGGCTGAACTACCATTTAATGGCTG AATTGGGCTGGATGAATGATCCGAACGGCTTCA TTCAAGAATGGCGATTTTCGTTCGTG | 98 |
| pmxAF | TAACGTTTTCACCCCATTGG | 99 |
| pmxAR | GGGAGCTTGGAGCTTTGCTG | 100 |
| pmxBF | TCCACAACTCGAGCTAAGCC | 101 |
| pmxBR | ACTTACCGCTCCAGTACTGTTC | 102 |
| pmxCF | GAACAAGTCAAGCGGCAGATC | 103 |
| pmxCR | CTTTCACTTGCGAGAGCCATC | 104 |
| pmxDF | CAGGAATTTACCGAGTCTGCC | 105 |
| pmxDR | GTCGCATTCGCAAGCAGGAAG | 106 |
| pmxEF | GAGCGGCTGAAACGTCAGGAAGCC | 107 |
| pmxER | CTGCTTCGCCTGTATGATTGTC | 108 |

Figure 8:
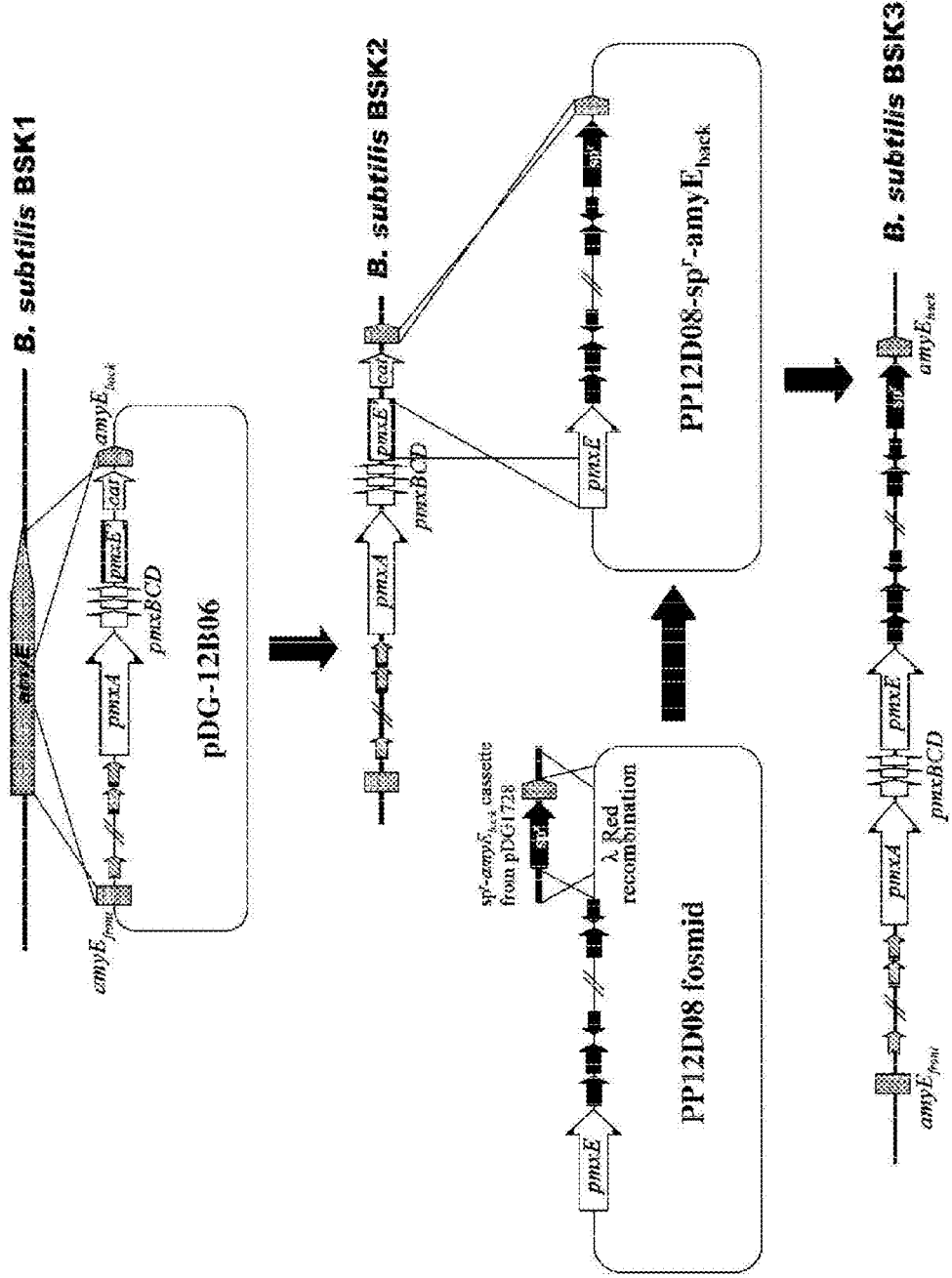
FIG. 8 is a schematic diagram for the transfer of pmx genes into *B. subtilis*.

DNA fragments upstream of ydiO and downstream of ydjA were amplified by PCR with primers ydiO-up-F and ydiO-up-R and primers ydjA-down-F and ydjA-down-R, respectively. The DNA fragments were inserted into the EcoRI and PstI sites of plasmid pBGSC6 (Fajardo-Cavazos et al., *J. Bacteriol.*, 175: 1735-1744, 1993) in tandem to construct plasmid pDBSUM. Transformation of *B. subtilis* was conducted using a previously reported method (Harwood, C. R., and S. M. Cutting (ed.). 1990. Molecular biological methods for *Bacillus*. John Wiley & Sons, Inc., New York, N.Y.). After single-crossover integration of the pDBSUM plasmid into the chromosome of *B. subtilis* 168, cells were grown in LB medium without antibiotics and then screened for chloramphenicol-sensitive colonies. BSK1, a resultant recombinant strain with a disrupted RM system, was constructed without any marker gene. Integration of the pmx gene cluster into the chromosome of BSK1 was conducted in two steps, using fosmid clones, as shown in FIG. 8. Fosmid PP12B06 containing pmxABCD, a truncated pmxE, and a 5'-flanking region was digested with BamHI, and the DNA fragment containing pmx genes was ligated into the BamHI site of integration plasmid pDG1662 (Guérout-Fleuryet et al., Gene, 180: 57-61, 1996) to construct pDG-12B06. The pmx genes of pDG-12B06 were introduced into the amyE locus of strain BSK1 by homologous recombination to construct strain BSK2. To restore truncated pmxE, the PP12D08 fosmid containing an entire pmxE gene and a 3'-flanking region was used. A recombinant fosmid, PP12D08-Sp$^r$-amyE$_{back}$, was constructed by integration of the Sp$^r$-amyE$_{back}$ cassette amplified from plasmid pDG1730 (Guérout-Fleuryet al., Gene, 180: 57-61, 1996) by PCR with primers 1730-12DF and 1730-12DR using a λ Red recombination system. Strain BSK3 containing the entire pmxABCDE sequence was constructed by homologous recombination between PP12D08-Sp$^r$-amyE$_{back}$ and the chromosome of BSK2. Functional sfp was introduced into BSK1 and BSK3 by transferring the chromosomal DNA of *B. subtilis* CB114 (Lee et al., *Appl. Microbiol. Biotechnol.*, 67: 789-794, 2005) to construct BSK1S and BSK3S, respectively. The whole gene cluster inserted into the genome of *Bacillus subtilis* BSK3 has the nucleotide sequence of SEQ ID NO: 109 and coding region for pmxABCDE is 8194$^{th}$ to 49233$^{rd}$ position of SEQ ID NO: 109. Construction of BSK2, BSK3, and BSK3S was confirmed by PCRs with the primer sets of pmxAF/pmxAR, pmxBF/pmxBR, pmxCF/pmxCR, pmxDF/pmxDR, and pmxEF/pmxER. Introduction of the functional sfp was confirmed by observing reduced surface tension of the culture broth as described in a previous study (Lee et al., *Appl. Microbiol. Biotechnol.*, 67: 789-794, 2005).

Figure 9:
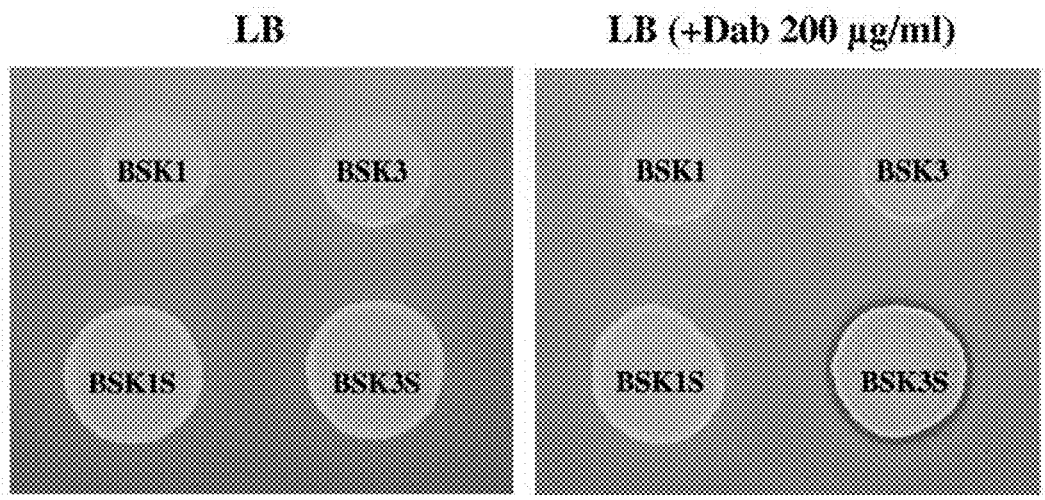
FIG. 9 is a series of photographs showing antibacterial activities of recombinant *B. subtilis* strains against *E. coli* under conditions with or without L-Dab.
Figure 10A:
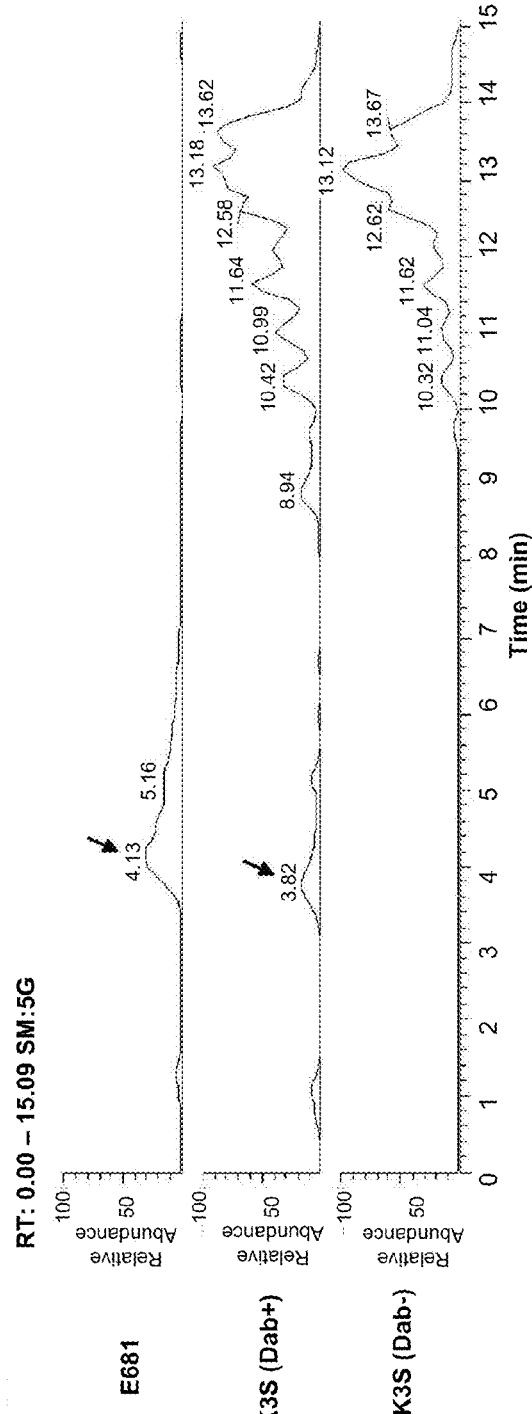
FIGS. 10A and 10B are a series of graphs showing LC analysis of culture supernatants of *P. polymyxa* E681 and *B. subtilis* BSK3S grown in GSC medium with or without L-Dab, using a Terra MS C18 column (FIG. 10A) and MS data for polymyxins produced by *P. polymyxa* E681 and *B. subtilis* BSK3S (FIG. 10B).
Figure 10B:
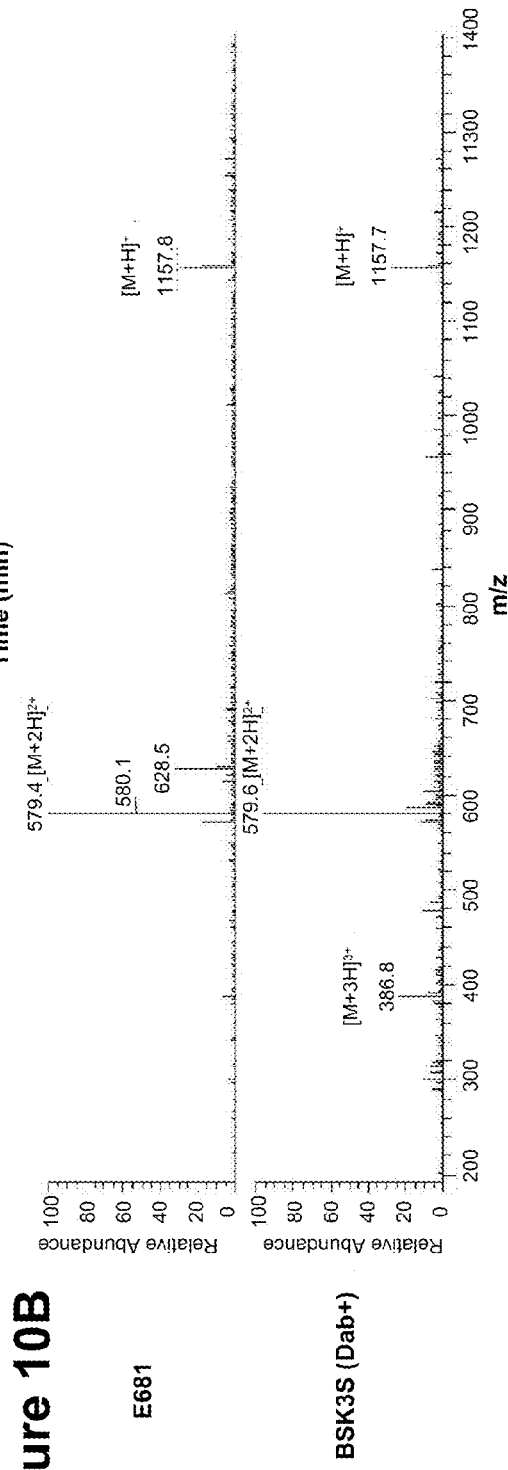

For the synthesis of nonribosomal peptide antibiotics, functional Sfp, a phosphopantetheinyl transferase, is required (Lambalot et al., Chem. Biol., 3: 923-936, 1996). Because Sfp in B. subtilis 168 is nonfunctional due to a mutation of the sfp gene (Tsuge et al., Antimicrob. Agents Chemother., 49: 4641-4648, 2005), a functional sfp gene from B. subtilis CB114 (Lee et al., Appl. Microbiol. Biotechnol., 67: 789-794, 2005) was introduced into BSK3 to construct strain BSK3S. However, the introduction of intact sfp still did not induce antibacterial activity (FIG. 9, left panel). The present inventors found that the synthetic mechanism of an amino acid, Dab, which is a major amino acid in polymyxin, was absent in B. subtilis 168. When Dab was added extracellularly in growth medium, the antimicrobial activity of strain BSK3S against E. coli was successfully detected (FIG. 9, right panel). LC/MS analysis of the supernatant of BSK3S grown in GSC medium containing Dab showed that the polymyxin peak of BSK3S had the same mass profile as that of P. polymyxa E681, thus demonstrating that B. subtilis BSK3S produced polymyxin (FIG. 10).

<5-2> Antibacterial Activity Assay.

The antibacterial activity was analyzed using freshly prepared E. coli plates. E. coli cells grown overnight in 3 ml of LB medium at 37° C. were mixed with 300 ml of LB agar, autoclaved, and cooled below 50° C. to prepare the plates. When necessary, L-Dab was added at a final concentration of 200 μg/ml. To analyze the antibacterial activity of culture supernatants of P. polymyxa strains and their extracts, 50 μl of each sample was loaded onto a paper disk and transferred to the E. coli plates. Recombinant B. subtilis cells grown overnight in 3 ml of LB medium at 37° C. were inoculated directly onto the E. coli plates by dropping 5 μl of the culture onto plates. Each plate was then incubated at 37° C. for 24 h to observe the growth inhibition effect.

<5-2> Improving the Transformed Bacillus subtilis Strain

Since Bacillus subtilis does not have a gene encoding diaminobutyrate aminotransferase (ectB), there is inconvenience that Dab should be added in culture medium in order to produce polymyxin. Thus, the present inventors introduced ectB gene from Paenibacillus polymyxa into genome of Bacillus subtilis BSK3 strain using a method described in Korean Patent Application No. 2009-0088575 which is incorporated herein by reference and designated the transformed strain as "Bacillus subtilis BSK4 strain". In addition, the present inventors introduced a gene encoding aspartokinase of Paenibacillus polymyxa into the transformed Bacillus subtilis BSK4 strain in order to prevent feedback inhibition due to accumulation of lysine and threonine using a method described in Korean Patent Application No. 2009-0088575 and designated the transformed strain as "Bacillus subtilis BSK(pHPaskP) strain". Further, the present inventors inactivated arbB gene of the Bacillus subtilis BSK4 and BSK (pHPaskP) respectively using a method described in Korean Patent Application No. 2009-0088575, in order to investigate whether abrB gene affects synthesis of polymyxin and designated the strains as "Bacillus subtilis BSK5 and BSK6", respectively. As a result, it was confirmed that the inactivation of arbB gene in the transformed Bacillus subtilis strains enhanced antibacterial activity against E. coli, which means the arbB gene controls the expression of genes for the synthesis of polymyxin negatively. Thus, the present inventors deposited the recombinant B. subtilis BSK6 strain at Korean Collection for Type Cultures (KCTC) under Accession Number of KCTC11557BP on Sep. 18, 2009.

Example 6

Isolation and Analysis of Polymyxin from Paenibacillus polymyxa ATCC21830 and F4

<6-1> Preparation Strains

Paenibacillus polymyxa ATCC21830 strain was purchased from ATCC and Paenibacillus polymyxa F4 strain was isolated from Korean soil and identified as a new strain of Paenibacillus polymyxa species as results of mycological analyses and 16S ribosomal DNA sequence analysis. The new strain was deposited at Korean Collection for Type Cultures (KCTC) located within Biological Resource Center (BRC) in the Korean Research Institute of Bioscience and Biotechnology (KRIBB) under Accession Number of KCTC11667BP on Mar. 17, 2010.

<6-1> Culture of Paenibacillus polymyxa ATCC21830 and F4

Paenibacillus polymyxa ATCC21830 strain and Paenibacillus polymyxa F4 strain were cultured respectively in the medium used by Choi et al. (Choi et al., J. Bacteriol., 2009, 191(10): 3350-3358, 2009) under aerobic condition at 30° C. with 200 rpm for 3 days, followed by centrifugation (7000 rpm, 10 min) to separate supernatant.

<6-2> Identification of Polymyxin by LC/MS Analyzing System

The composition of the supernatant was analyzed by LC/MS system.

LC/MS was performed using high pressure liquid chromatography system provided by Thermo Electron Co. (USA) and ion spectrometer. The sample proceeded to reversed-phase column (YMC Hydrosphere C18 column) and analyzed in a mixed solvent of acetonitrile and water containing 0.1% formic acid (0.2 Ml/min).

Figure 11A:
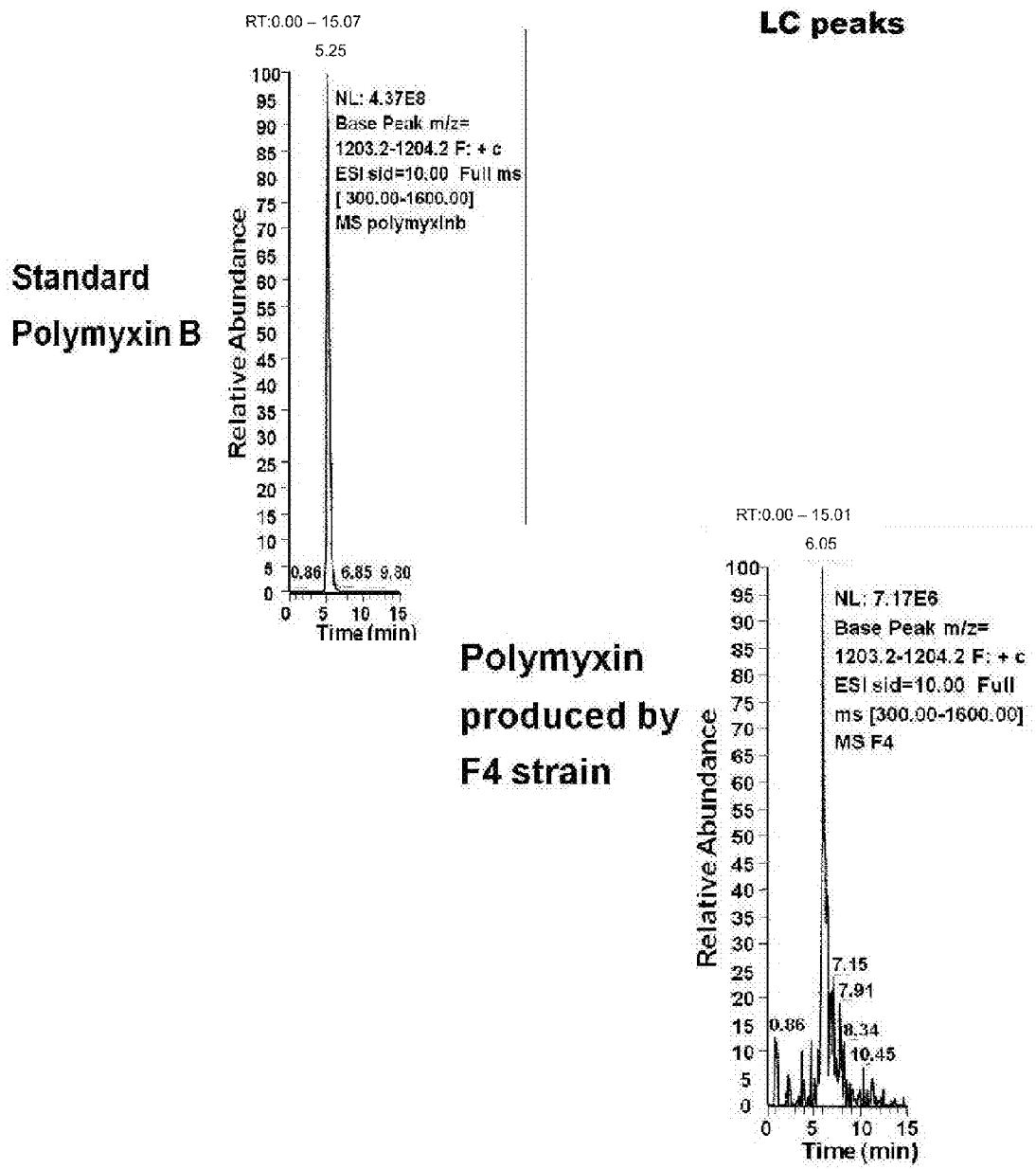
FIGS. 11A and 11B are a series of graphs showing LC analysis and MS analysis (FIG. 11A) and MS analysis (FIG. 11B) for a commercial polymyxin B sample (upper panel) and polymyxin produced by F4 strain (lower panel)
Figure 11B:
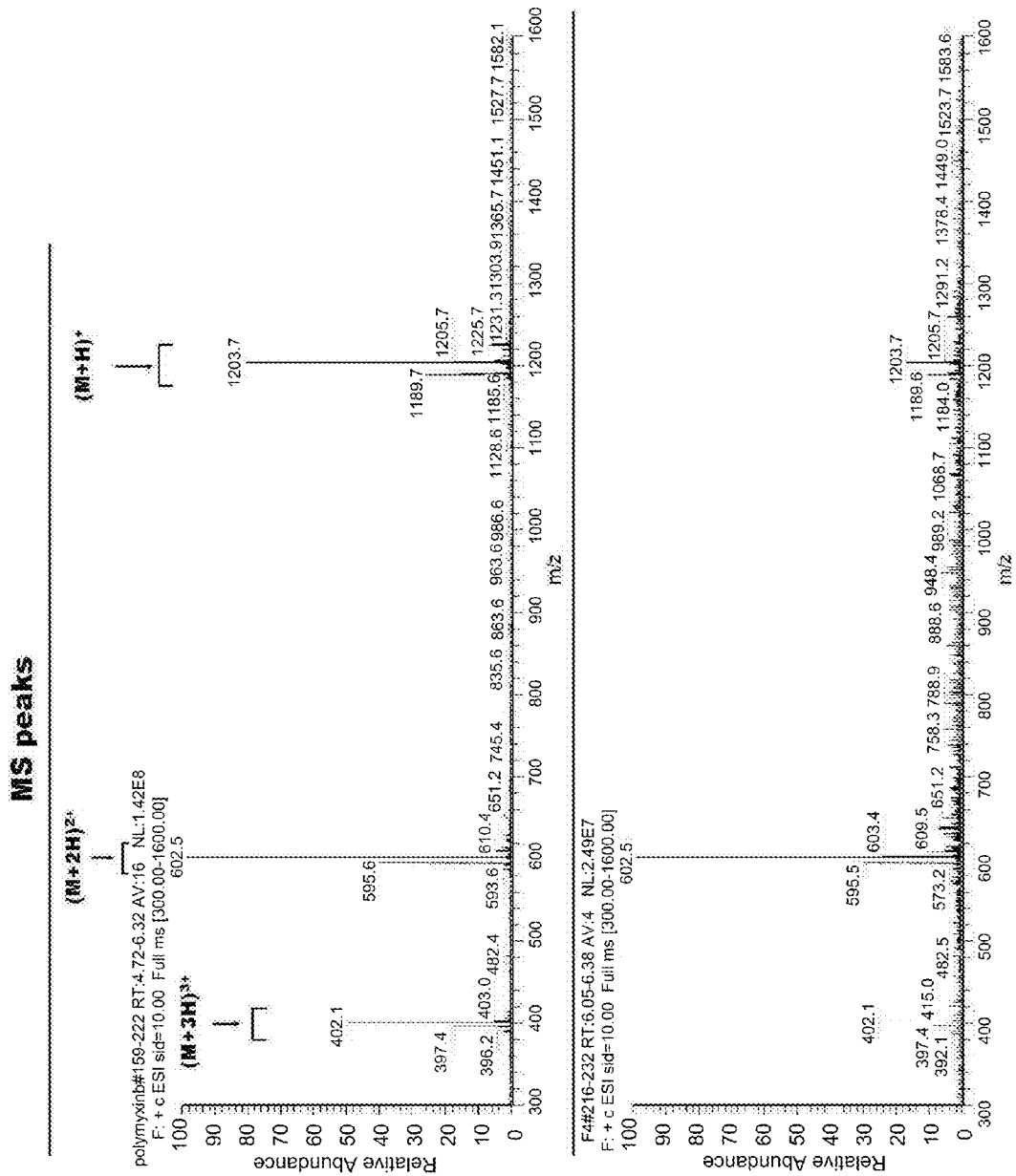

As a result, in case of F4 strain, $(M+H)^+$ ion mass was 1203.7, $(M+2H)^{2+}$ ion mass was 602.6 and $(M+3H)^{3+}$ ion mass was 402.0, which is the same molecular weight of the conventional polymyxin B (Catalog No. P0972) purchased from Sigma-Aldrich Co. as a standard material (FIG. 11). Therefore, F4 strain produces polymyxin B. Since it was reported that ATCC21830 strain produces polymyxin E (Koyama, Y. et al., J. Antibiot., 3: 457-458, 1950), the present inventors did not perform LC/MS analysis on ATCC21830 strain.

Example 7

Sequencing of Polymyxin Biosynthesis Gene of ATCC21830 Strain and F4 Strain

The nucleotide sequences of Paenibacillus polymyxa ATCC21830 genome and F4 genome were completely sequenced by whole-genome shotgun sequencing strategy and then the polymyxin synthetase gene cluster was identified.

<7-1> Library Construction

Paenibacillus polymyxa ATCC21830 strain and F4 strain was cultured in tryptic soy broth (TSB) for 16 hours and chromosomal DNA was extracted by the method described in Genome Analysis, A laboratory manual Vol. III Cloning systems (CSHL Press, Cold Spring Harbor, N.Y., USA), and the DNA was fragmented to construct shotgun library for sequencing. The shotgun library was constructed using Copy-Control™ fosmid library production kit (Epicentre Biotechnologies, USA). Clones containing gene clusters encoding polymyxin synthetase were screened using colony hybridization method from 1,500 clones selected from two sets of fosmid library constructed from two strains, respectively. At this time, as a probe, a 700 bp sized PCR product containing about 300 by at 3'-end of pmxC and 400 bp at 5'-end of pmxD, which is constructed with pmxCC primer (SEQ ID NO: 110, gagcttttctgaaggatg), pmxDN primer (SEQ ID NO: 111, ggtcgttacgtcgttgttc) and Dig-labelling kit (Roche Diagnostics Corporation). Thirty two positive clones were selected from each library primarily and DNA Dot blotting was performed using the proved described above after extracting fosmid DNA from the clones. Thirteen positive clones per strain were selected and were put into sequencing analysis. And then, it is confirmed that the inserted fragments include which parts of gene cluster for the polymyxin synthesis.

<7-2> Nucleotide Sequence Analysis

Two clones containing whole gene cluster for the polymyxin synthesis of ATCC21830 and F4 strain, respectively were selected from 3'- and 5'-end sequence information and DNA sequences were analyzed.

The high molecular chromosomal DNA fragmentation was performed with VCX-500 ultrasonicator (Sonics, Newtown, Conn., USA) with 19% strength, 0.3/3 sec of pulse on/off time, 6 times. The DNA fragments of 1.5-2 kb in size were recovered, blunt-ended and used to construct the library. The blunt-ended DNA fragments were inserted into Sma I site of pUC19 plasmid (Stratagene, USA). The reactant for the plasmid library was inserted into E. coli DH5α by heat-shock method, which was plated on a LB agar plate medium containing X-gal/IPTG/Amp (Ampicillin). White recombinant colony was inoculated to a 96 deep-well plate containing LB(Amp) liquid medium, followed by shaking-culture in a 37° C. incubator with 250 rpm for 16 hours. Cells were recovered and plasmid DNA was separated and purified according to the standard method.

DNA sequencing was performed by using BigDye™ terminator cycle sequencing kit (Applied Biosystems, USA) and the reactant was analyzed with ABI 3700 and 3730 DNA analyzer (Applied Biosystems, USA). Files containing the results were analyzed with phred/phrap/consed program (//www.phrap.org). All the result files were analyzed with Phred to organize nucleotide sequences and relevant results were collected to mask the sequence of the vector. Sequence combining was carried out by Phrap and contig confirmation and edition and primer design were carried out by consed.

Approximately 200 plasmid clones were analyzed in both directions and information of 6.7 times of nucleotide sequences were obtained from the termini of the plasmid, resulting 40 kb sized whole nucleotide sequence by sequencing combining. As a result, approximately 800 contig sequences were obtained, followed by finishing. After ORF analysis, it was identified that PmxA of F4 strain consists of 4959 amino acids (SEQ ID NO: 13), PmxB of F4 strain consists of 1102 amino acids (SEQ ID NO: 14), and PmxE of F4 strain consist of 6282 amino (SEQ ID NO: 15), whereas PmxA of ATCC21830 strain consists of 4966 amino acids (SEQ ID NO: 16), PmxB of ATCC21830 strain consists of 1102 amino acids (SEQ ID NO: 17), and PmxE of ATCC21830 strain consist of 5789 amino acids (SEQ ID NO: 18). With respect to nucleotide sequence, in case of F4 strain pmxA gene has nucleotide sequence of SEQ ID NO: 4, pmxB gene has the nucleotide sequence of SEQ ID NO: 5 and pmxE gene strain has the nucleotide sequence of SEQ ID NO: 6. In case of ATCC21830 strain, pmxA gene has the nucleotide sequence of SEQ ID NO: 7, pmxB gene has the nucleotide sequence of SEQ ID NO: 8 and pmxE gene has the nucleotide sequence of SEQ ID NO: 9.

Figure 12:
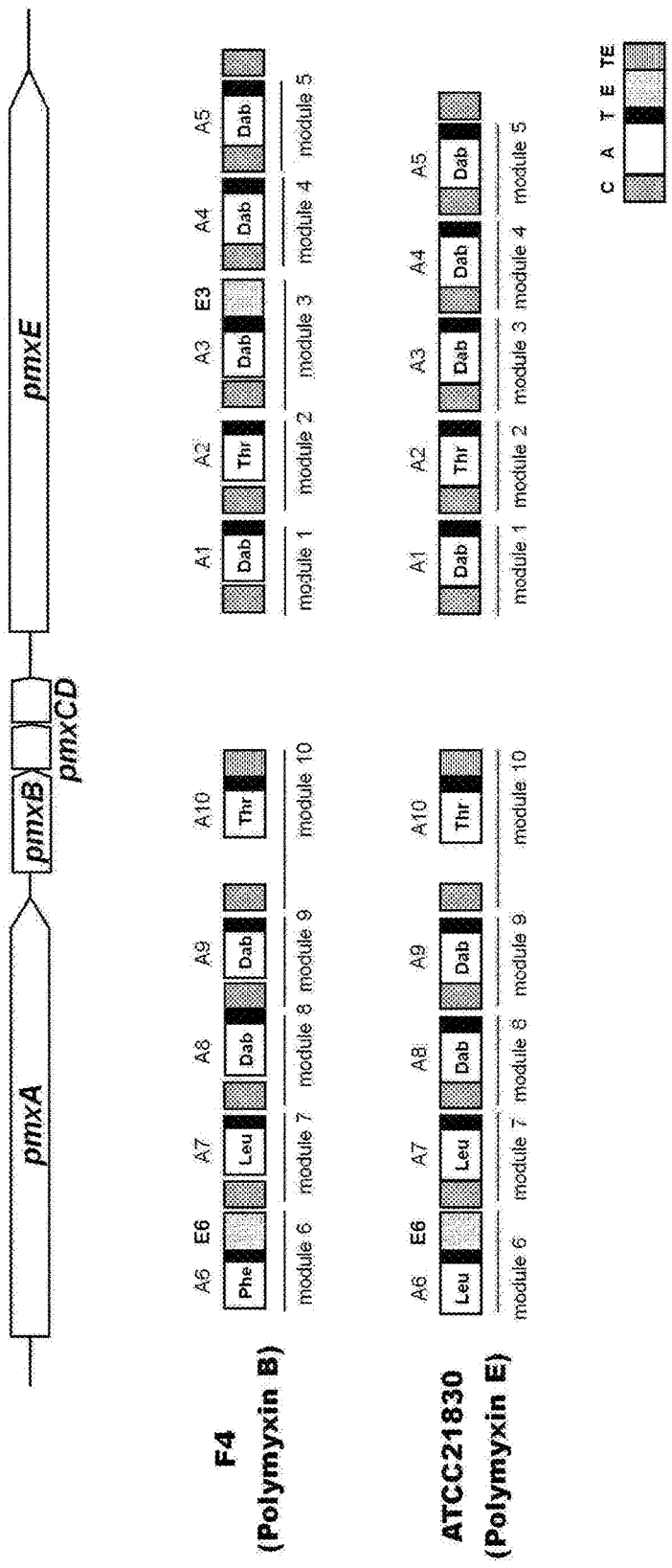
FIG. 12 is a diagram illustrating structures of gene clusters encoding polymyxin synthetases from ATCC21830 and F4 strains and detailed structures of each subunit of the polymyxin synthetases.
Figure 13:
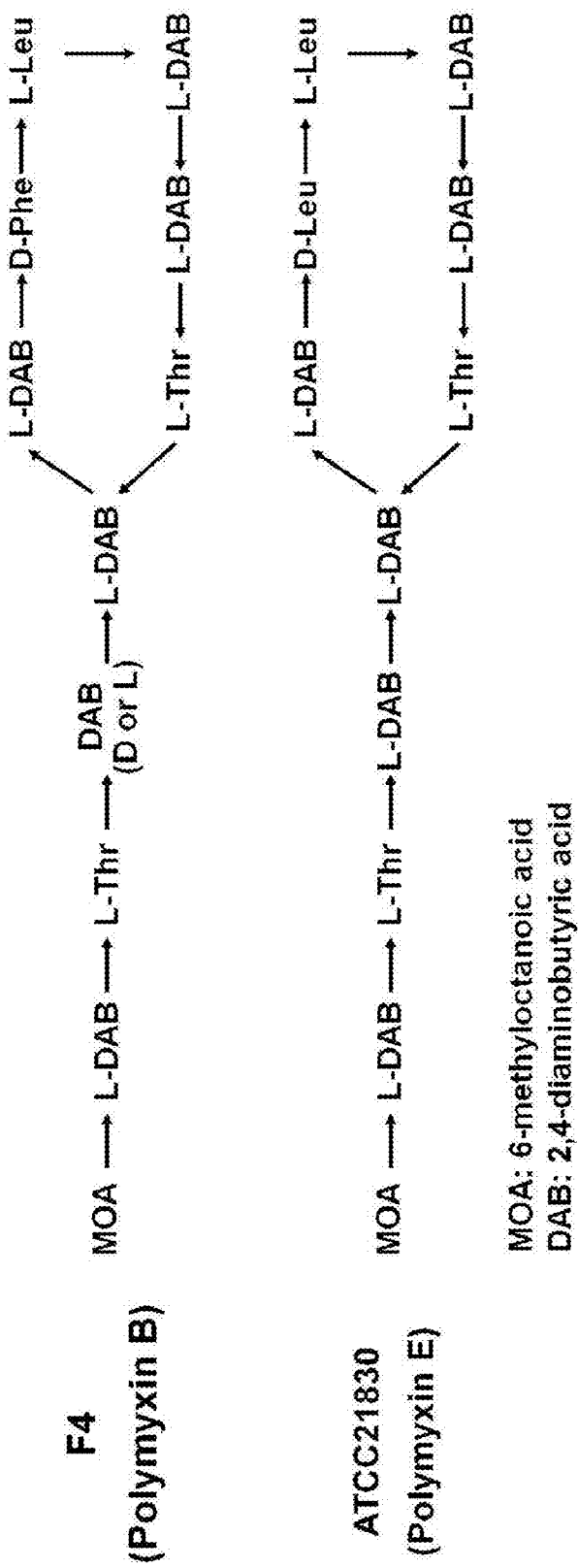
FIG. 13 is a diagram illustrating of the structures of polymyxins predicted from the domain structure of polymyxin synthetase of ATCC21830 strain and F4 strain, respectively.

<7-3> Prediction of Structure of Polymyxins from Nucleotide Sequence for the Polymyxin Synthesis After analyzing the whole nucleotide sequences for the polymyxin synthesis of the identified *Paenibacillus polymyxa* ATCC21830 and F4 strains according to Ansari et al. (Ansari et al., *Nucleic Acids Res.*, 32: W405-W413, 2004), it was confirmed that the structures of gene cluster for the polymyxin synthesis of two strains were same as that of *Paenibacillus polymyxa* E681 and A domains of each module of PmxA, PmxB and PmxE recognize Dab, Leu, Thr and Phe as depicted in FIG. 12. Through the analysis, the polymyxins produced from ATCC21830 and F4 strains were predicted as polymyxin E and polymyxin B, respectively and the result is exactly same as that of LC/MS analyses described in Example 6. However, it was identified that the third module of PmxE of F4 strain has an epimerization (E) domain which converts L-Dab to D-Dab (FIG. 13). It suggests that the $3^{rd}$ amino acid, Dab of polymyxin B produced by F4 strain is D form whereas it was reported that polymyxin B has L-form of Dab in the third position, previously.

Through the results, it was confirmed that the gene clusters for the polymyxin B and E synthesis consist of five genes, pmxA, pmxB, pmxC, pmxD and pmxE and genes encoding polymyxin synthetase are pmxA, pmxB and pmxE, same as Choi et al. (Choi et al., *J. Bacteriol.*, 191(10): 3350-3358, 2009). In addition, it was confirmed that the order of polypeptide subunits are PmxE, PmxA and Pmx B. Therefore, in light of three gene clusters identified above, it is predicted that polymyxin synthetases producing various polymyxins share the above structure.

Industrial Applicability

As explained hereinbefore, the present inventors confirmed that polymyxin could be produced, separated and purified from *Paenibacillus polymyxa* E681, ATCC21830 and F4 strains respectively and then the whole nucleotide sequences and structures of gene clusters for the polymyxin synthesis were analyzed, by which the gene clusters were identified as polymyxin synthetase genes. The polymyxin synthetase of the invention can be effectively used for the development of a novel antibiotic and the increase of productivity of polymyxin.

Sequence List Text

SEQ ID NO: 1 is pmxA DNA sequence of *Paenibacillus polymyxa* E681 strain, SEQ ID NO: 2 is pmxB DNA sequence or *Paenibacillus polymyxa* E681 strain, SEQ ID NO: 3 is pmxE DNA sequence of *Paenibacillus polymyxa* E681 strain; SEQ ID NO: 4 is pmxA DNA sequence of *Paenibacillus polymyxa* F4 strain, SEQ ID NO: 5 is pmxB DNA sequence of *Paenibacillus polymyxa* F4 strain, SEQ ID NO: 6 is pmxE DNA sequence of *Paenibacillus polymyxa* F4 strain; SEQ ID NO: 7 is pmxA DNA sequence of *Paenibacillus polymyxa* ATCC21830 strain, SEQ ID NO: 8 is pmxB DNA sequence of *Paenibacillus polymyxa* ATCC21830 strain, SEQ ID NO: 9 is pmxE DNA sequence of *Paenibacillus polymyxa*

ATCC21830 strain; SEQ ID NO: 10 is PmxA amino acid sequence of *Paenibacillus polymyxa* E681 strain, SEQ ID NO: 11 is PmxB amino acid sequence of *Paenibacillus polymyxa* E681 strain, SEQ ID NO: 12 is PmxE amino acid sequence of *Paenibacillus polymyxa* E681 strain; SEQ ID NO: 13 is PmxA amino acid sequence of F4 strain, SEQ ID NO: 14 is PmxB amino acid sequence of F4 strain, SEQ ID NO: 15 is PmxE amino acid sequence of F4 strain, respectively; SEQ ID NO: 16 is PmxA amino acid sequence of ATCC21830 strain, SEQ ID NO: 17 is PmxB amino acid sequence of ATCC21830 strain, SEQ ID NO: 18 is PmxE amino acid sequence of ATCC21830 strain, respectively; SEQ ID NO: 19 is pmxC DNA sequence of E681 strain, SEQ ID NO: 20 is pmxD DNA sequence of E681 strain, SEQ ID NO: 21 is PmxC amino acid sequence of E681 strain and SEQ ID NO: 22 is PmxD amino acid sequence of E681 strain.

SEQ ID NOs: 23 to 82 are amino acid sequences of each domain of gene cluster encoding polymyxin A synthetase of *Paenibacillus polymyxa* E681.

SEQ ID NO: 23 is N terminal (297 aa: 1-297) sequence of PmxA, SEQ ID NO: 24 is A6 (505 aa: 298-802) sequence, SEQ ID NO: 25 is A6-T6 linker (18 aa: 803-820) sequence, SEQ ID NO: 26 is T6 (64 aa: 821-884) sequence, SEQ ID NO: 27 is T6-E6 linker (17 aa: 885-901) sequence, SEQ ID NO: 28 is E6 (460 aa: 902-1361) sequence, SEQ ID NO: 29 is E6-C7 linker (9 aa: 1362-1370) sequence, SEQ ID NO: 30 is C7 (437 aa: 1371-1807) sequence, SEQ ID NO: 31 is A7 (530 aa: 1798-2327) sequence, SEQ ID NO: 32 is A7-T7 linker (20 aa: 2328-2347) sequence, SEQ ID NO: 33 is T7 (63 aa: 2348-2410) sequence, SEQ ID NO: 34 is T7-C8 linker (21 aa: 2411-2431) sequence, SEQ ID NO: 35 is C8 (425 aa: 2432-2856) sequence, SEQ ID NO: 36 is A8 (557 aa: 2855-3411) sequence 2 aa overlapped with C8, SEQ ID NO: 37 is A8-T8 linker (18 aa: 3412-3429) sequence, SEQ ID NO: 38 is T8 (65 aa: 3430-3494) sequence, SEQ ID NO: 39 is T8-C9 linker (22 aa: 3495-3516) sequence, SEQ ID NO: 40 is C9 (424 aa: 3517-3940) sequence, SEQ ID NO: 41 is C9-A9 linker (19 aa: 3941-3959) sequence, SEQ ID NO: 43 is A9 (509 aa: 3960-4468) sequence, SEQ ID NO: 43 is A9-T9 linker (18 aa: 4469-4486) sequence, SEQ ID NO: 44 is T9 (65 aa: 4487-4551) sequence, SEQ ID NO: 45 is T9-C10 linker (21 aa: 4552-4572) sequence, SEQ ID NO: 46 is C10 (381 aa: 4573-4953) sequence, SEQ ID NO: 47 is N terminal (300 aa: 1-300) sequence of PmxB, SEQ ID NO: 48 is A10 (530 aa: 301-830) sequence, SEQ ID NO: 49 is A10-T10 linker (14 aa: 831-844) sequence, SEQ ID NO: 50 is T10 (62 aa: 845-906) sequence, SEQ ID NO: 51 is T10-TE linker (25 aa: 907-931) sequence, SEQ ID NO: 52 is TE (171 aa: 932-1102) sequence, SEQ ID NO: 53 is N terminal (70 aa: 1-70) sequence of PmxE, SEQ ID NO: 54 is C1 (432 aa: 71-502) sequence, SEQ ID NO: 55 is A1 (535 aa: 498-1032) sequence 5 aa overlapped with C1, SEQ ID NO: 56 is A1-T1 linker (15 aa: 1033-1047) sequence, SEQ ID NO: 57 is T1 (64 aa: 1048-1111) sequence, SEQ ID NO: 58 is T1-C2 linker (21 aa: 1112-1132) sequence, SEQ ID NO: 59 is C2 (427 aa: 1133-1559) sequence, SEQ ID NO: 60 is A2 (520 aa: 1558-2077) sequence 2 aa overlapped with C2, SEQ ID NO: 61 is A2-T2 linker (20 aa: 2078-2097) sequence, SEQ ID NO: 62 is T2 (63 aa: 2098-2160) sequence, SEQ ID NO: 63 is T2-C3 linker (21 aa: 2161-2181) sequence, SEQ ID NO: 64 is C3 (427 aa: 2182-2608) sequence, SEQ ID NO: 65 is C3-A3 linker (31 aa: 2609-2639) sequence, SEQ ID NO: 66 is A3 (556 aa: 2640-3195) sequence, SEQ ID NO: 67 is A3-T3 linker (14 aa: 3196-3209) sequence, SEQ ID NO: 68 is T3 (61 aa: 3210-3270) sequence, SEQ ID NO: 69 is T3-E3 linker (20 aa: 3271-3290) sequence, SEQ ID NO: 70 is E3 (459 aa: 3291-3749) sequence, SEQ ID NO: 71 is E3-C4 linker (11 aa: 3750-3760) sequence, SEQ ID NO: 72 is C4 (437 aa: 3761-4197) sequence, SEQ ID NO: 73 is A4 (556 aa: 4195-4750) sequence 3 aa overlapped with C4, SEQ ID NO: 74 is A4-T4 linker (18 aa: 4751-4768) sequence, SEQ ID NO: 75 is T4 (65 aa: 4769-4833) sequence, SEQ ID NO: 76 is T4-O5 linker (21 aa: 4834-4854) sequence, SEQ ID NO: 77 is C5 (425 aa: 4855-5279) sequence, SEQ ID NO: 78 is A5 (556 aa: 5277-5832) sequence 3 aa overlapped with C5, SEQ ID NO: 79 is A5-T5 linker (18 aa: 5833-5850) sequence, SEQ ID NO: 80 is T5 (64 aa: 5851-5914) sequence, SEQ ID NO: 81 is T5-C6 linker (21 aa: 5915-5935) sequence, SEQ ID NO: 82 is C6 (377 aa: 5936-6312) sequence.

SEQ ID NOs: 83 to 92 are primers for constructing a pmxE mutant, SEQ ID NOs: 93 to 108 are primers for constructing a transformed *Bacillus subtilis* whose genome comprises whole gene cluster encoding polymyxin synthetase of *Paenibacillus polymyxa* E681, SEQ ID NO: 109 is a nucleotides sequence comprising the whole gene cluster containing pmxABCDE genes SEQ ID NOs: 110 and 111 are primers for preparing a probe used for colony hybridization.

Those skilled in the art will appreciate that the conceptions and specific embodiments disclosed in the foregoing description may be readily utilized as a basis for modifying or designing other embodiments for carrying out the same purposes of the present invention. Those skilled in the art will also appreciate that such equivalent embodiments do not depart from the spirit and scope of the invention as set forth in the appended claims.

---

SEQUENCE LISTING (111 sequences)

SEQ ID NO: 1 - DNA, 14862 bp, Paenibacillus polymyxa E681
atggcttttgaaaaagaaacgttgttttggaacgaaaaatttggtaacgacgattataccttgacgcggctgccttacagcaaagctccaagctccctggcgcccattatgacaaccgtcggcggttcgctttcggaggaagcggcgcagcgcgtccttcaaatgagcaagggcgctccgctggccgcttttatgattttgctcgccggtgttcagtcgctcttgcataaatatacaggcgcttctgacattctggtcggcatgccggttgtacggaaaccgacggagacgcgccgatccgttaatcatacggtcattttgaaaaactcgctttcggcgggtgcgacttttaaaacgcttctgaacgagctgaggacttccttgccgagagcgattcagcatcaacatattccgttcttgaaaatgacggagaagctggacctgcaatatgcagacgggatacccgtcgtccatacgctagtatcccttaaggagctgcatctggacgaaatcgggcaaaacgtggtcacggattgttcctttgaattcagcttaaccggcgggacgatacagctagcgctgtcatataacgagcacttatatgactccgagttcatgactcgggtcgtcggccatctgaatcgcctgctggtcgtggggcttcacgagttggagctggacatcgtgcgggcggacatgctgtcggaagacgagaaatttcaattgctgcaaagctttaacgataccgagaaggactatccccgtgatcggacaattcatcagctcgtggaggagcaggcgaagcgggtgcccgaagcgacggcggttgtctttgaggggcggcggctttcgtacgcggagctgaacgaacgggcgaaccggctggcgcggacgttgcgatcgatcggcgtgctgcccaatcagctggtaggcttgatggtcagaagatcgttggagacggtcgttggcattctggcggttctgaaagctggcggtgcctacgtgccgatcgacccggaatacccggaagaacgcatccgctacattttggagaactcgaacgcgcagctgctgctgactcaaagggagctgctgcagctgcaggtgccgttcgaagggaccgtggtggcgctggatgacgagcaggcctacagcgacgatggctcgaacctggagccggccagcggtccgaacgatctggcttatgtcatctatacgtcaggtacgacgggcaatcccaaaggggtcatgctggagcatcacggtttggtcagcttgaagctgatgttcgcggacaggctgggcatcacggagcatgaccggatcgttcaattcgccagcctgtcgttcgacgcgtcctgctgggaagtgttcaaagcgctctattttggcgcggctttgtacatcccgacggccgagacgattctcgacaaccgcctgttcgagagttatatgaacgagcatgcgattacggcggcgattttgcctccgacgtacagtgcttatttgaacccggaccgccttcccagcttaacgaagctcgtaacgggaggctcggcggtatcggccgaattcgtgcagcagtggaaacgcaaggtccactatttcaatgcttacggccctaccgaagcttcgattgttacgacgctttgggatgcggatgaggagcagccggagggcagagtcattccgatcgggcgcccgctggccaatcaccggatttttattttggatgcccacctgcagcttgtgcctccgggagtggacggcgagctgtgcgtggcaggcgtggggcttgcgagaggttacctgaaccatccggagctgacggcagagaagttcgtggaacatccgtttgcgccgggagaacgcctttaccggacgggagatctcgcccgctggctgccggacggaaatgttgagtacttgggccggatcgaccatcaggtgaaaatccgtggattccggatcgagatcggcgagattgaagagcagcttctgaagatcgactccgtgcaggagacgatcgtaatcgcgcgggaaggcaaaagcgggcaagaactgtgcgcttacctggtcgcgggccgcccgcttacgctcggcgagctaagaagcgcgctggcgcaaaaattgccgaattacatgattccggcgcattttgttcagcttccgcagatgccgctcacgccgaacgacaaaatcgaccgcaaggctttgcccgctccggaaggaaacgcgctgaccggcggcgcgtacgtagctccccgcaatgaagccgagcggacgcttgccgatgtgtggcaggcggtattgaacgccgatcgcgttggggtaacggatcatttcttcgagctgggcggagactcgatcaagtccattcaagtatcttcgcggcttcatcaagccgggtacaagctggaaatccgggatttgttcaaatatccgactatttcacagctcagcctgcatgtgaaaccgatcggacgtaccattgatcaaggcgaaataacgggtgaaacggcgctgacgccgattcagcattggtttttcgagagctcctttgcggacccgcatcatttcaaccagtcggtgatgctgtaccggaaggagcgcttcgacgaagagacggtgcgtcaggtgctgcaaaagctggccgagcatcatgacgccttgcggatggtgttccgcaagacggaacaagggtttagcgcgcggaaccgcgcgattcaggacggcgggttgttcacgctggacgtgttcgacttcaaggatgcggagaataccgagcaggctgtggaagcgaaggcaacggacattcaagcgggcatcgatctggagaacgggctcctcttgaaggcgggactgttccggtgcgcggacggagatcatttgctgctcgcggttcatcatgccgtggtggatggcgtgtcttggcgcattttgatggaggatttcgctctgggttacgagcaggccggcaaaagcgaggaaattcgtttcccggcgaaaacggatgcgtaccgcacttggtccgaacagctggccgcttacgcgcaaagcccggaaatgacgaaggaacgggcctattggcaggccatggaacaaattgcggttccggcggtgccgaaggatctggatgtggacgttacgacgcagcaggacagcgaatcgctgttcgtccgtttgactcccgaagaaacggagctgctgctgaagcgggttcaccgggcctacaacaccgaaatgaacgatattttggtaacggcgctcggcatagccattcgcaagtggacgggacacgaacgggtgcggatcaatctcgaaggacacggacgcgaatcgatcggaacggatatcgacatcacgcgcacagtcggctggtttacgaccaagtttccggtcgtcctggagccggaaaccgaccgggatttggcctatcagattaaacaggtcaaggaaagcttgcgccgcattccgaacaaggggcttgggtacggcgtatgccgctatctctccaaatcggaggatggctttgtttggggcgcagagccggaaattaattttaactacctcggccagttcgacgatgatgtcagtcaggtcgagatcggcatatcttcttattccagcggcagcccggccagcgaccggcaggcccgcagctttgtgctggatatcaacggcatggtgctggacggcgctttatcgctcgatctcagctacagccggaagcagtatcgcaaggaaacgatggaagccttcgctcagcggcttgagcaaagtctgcgagagctcattacccactgcgcaggcaaagaaaacaccgaattgacgccgagcgacgtgcaatttaaaggcttgaccatcgcggaattggagcaaatcgcccagcgctcgggccatctcggggaaatcgaaaatatttactcgcttacgccgatgcagaagggcatgtggttccacagcgcgcttgaccggcaaactgccgcttacttcgagcagacgcggtttacgatgcggggagcgctcgacgtccagcttttcgagaggagctggatggagcttgcgaaacgtcatctggtgctgcgggcgaattttgtgaaaggaccggagggcgagccgctgcaagtcatataccgcgacaagccggtcggctttgaatatgaagagctgcttcatttgcaggcggacgagaaacaagcgtatttggataaaaaggccgaggatgacaagcttcgcggcttcgacatggaacatgacgcgctcgttcgggttacgatcttgcgcaccgaagagcaaagctatcatgtgctgtggagtttccagcatattttgatggacggctggtgcctgccgcagctgacgcaggagctgtttgagatgtactcggccttggcatccggcaagcagccagcgggagataagggatcggattatggcgcttatatcgaatggttggagaaacaggacgatcaggcggcatccggctattggacggcattcctggcagattatgaagggcaaaccgtactcccgggacaaaaggaaccggcgccaagcggcatatttacggctgatcacgtcaccgccgagctgggcaaggacttgagcgagcggatggaccgggtggcgaaacagcgcctggttacggtcaatacgctgctgcaagccgcttggggcgtgatgctgcaaaaatataacggaacaaacgatgccgtattcggcagcgtcgtggccggaagaccggcggaaatcccgggcattgagtccatgatcgggctgttcatcaatacggtgccggtccgcgtcacgagcgaagcggacaccgtgttcgccgacctgatggcgaagctccaagagcgggcgctggagtccgggcgatatgattactatccgctgtatgaaattcaagcccgcagcgtgcaaaagcagaacctgatcaaccatatcatcgctttcgagaactatccggtggacgagcagatggagcaggcgggcgaccagcagcacggcgacctgacgatcgctgacgttcagatggaggagcagacgaactataacttcaacgtgaccgtggtgccgggagtcgagatcgaaattcggttcgactttaacgctgaagtgttcgataaagacagcatcgagcggctcaagggacacctcgtccatctgctggagcaggtgacggataacccggaaattacagtgggcgagctggaacttgtgacggagggggaaaaggccgaccttctcggacgttttaacgacaccaccacggaatttccgcgcgggaagacgctcgttcaattgttcgaagaacaggcggagctttacccggacaacgtggccgccgtcatgaacgagcggcaactgacctaccgcgagctgaacgagcgatccaaccgccttgcgcggaagctgcgagagacgggagtagaagcggaccagctggtagcgattctggccgaacgctcgctcgatatggtcgtcggcattctggccattctcaaagcgggcggagcctacgtacctgtcgatcccgactacccggaggagcgcatccgcttcatgatcgaggattcgggcgcgccgttattgctgattcaaaagcatctgcacgagaagaccgacttcgcaggaacgcgcctcgaattggacgatttcgtttggggcgacagaggggcggactccgccgatgcgttggacgcttcgaacctggagccgatttccgggccgggcaacctggcatatgtcatctacacgtcgggaacgaccggcagaccgaaaggaacgctgatcgagcataagaacgtcgtgcggctcctgttcaacgacaagaacctgttcgacttcgggccgtccgacacgtggacgctgttccactcgttctgcttcgatttctccgtctgggaaatgtacggagcgctgctgtacggaggcaagctggtcatcgtaccgtcgctcacggcgaaaaatccggccgatttcctggcgttgctgggccgcgaacaggtcacgattttgaaccagacgccaacatacttctaccagctgctgcgtgaggtcttggcggaccatccgtacgatctgcggattcgcaacgtcatctttgggggcgaagcgctgagtccgctgctgctcaagggcttcaagacgaagtacccggagacgaagctgatcaatatgtacggcattaccgagacgacggttcacgtgacgtataaggaaatcacgtgggtcgaaatggaggcggcgaagagcaatatcggcaagccgatcccgacgttgagggtgtacgtcctagatgaaaaccgccgccctgtgccgatcggcgtagcgggcgaaatgtacgtggccggggaaggccttgcgagaggatacctgaaccgtccggatctgacggcggagaagttcgttgattccccgtttgcggagggggagaaactgtaccgttcgggcgacttggcggcttggctgccggacggcaacatcgaatacctgggccggatcgaccaccaggtcaaaatccgtgggtaccggatcgagctggacgaaatcgagacgcagcttctgaacgtccggggtgtggaagaagcggtggtgctcgcccgtcaggacggcgggggcgagaaggcgcttgtcgcctactttgtggcggaccggacgctgacggtcagcgaaatgagaacctcgctggcccagggaatgccggggtacatgatcccgtcgtacttcgtgcagttggagcgcatgccgctgacgaccaacggcaaagtggaccgcaaagcgctgccggagccgcaaggcggcatacaaacgggtgtcgaatacgtagcgccgcgtaactggacggagtcccagcttgtgaagatctgggaggaagtgctgggctactccggcattggagtcctggacaatttcttcgagctcggaggccactccttgcgggcgacgaaccttgtcagcaagattcagaaggaaatgaacgtcgagctgcctctgcgcgacgtattccgctattcgacgatcgaagagatggctcttgccatctcccggatcggagagcagtcgttctcgtcgattccgctggcaggcgcaagagcatattatccgctttcctcagctcagaagcggctgtttatcctgaatcagctggaaggggccgatcagagctacaacatgccgggggtgctgctgctggaaggatcgattgaccggagcctgctggagaaggctttccgcggactgatcgcacggcacgaaacgctgcgaaccggctttgagattgtacaaggcgaagcaatacagcgcatttacgagagcgtcgactttgccgtcgagtaccgtcatgcgagcgaggaagaagcgcctgaagtcgtgcaggccttcatccggcctttcgacttggcgaagcccccgttgctgcgggcggagctcgtagagctggcagccgaacgttacttgctgatgttcgacatgcaccatatcgtctccgacggggtttcgatggacgtgttagtcgaggaactcgttcgtctgtacggcggcgagtcattagagcctttgcgcattcaatacaaggactatgcggtatggcagcagtcggacgagcaaaaagtgcagttgaaacgcgaggaagcttactggctggaccgttaccggggcgagctgccggttctggaaatgccgacggactatccgcgtcctgccgtgcagagctttgagggacaaacgctgacgtccttcgtggacgaggcaacgaacgaaggcttgaagcagctggccgctcaaagaggaacgacgctgtatatggtgctgcttgcggcatataccgtgcttttgcataaatacacaggtcaggacgatttgatcgtcggaacgtcgattgcgggcagaacgcacggagacacgcagcctttgatcggaatgttcgtcaatacgctggcgctccgcaattatccggcttcgaagaagaccttcctgtcgtatctggaagaagtgaaagaaacgactttaggcgcttacgagcatcagaattatccgttcgaagagctcgttgataaagtgcaggtcagccgggatttgagccgcaacccgctgtttgacacgatgttctccctgcaaaacttggaggataaagagtttgagctggaagggctgaaattgtcctcgtaccctagcgaatacggcacggccaagttcgacctgagtgtggatgttacggaagaaaacggcggcctggagtgcagctttgaattcgcaacggctctttataaagaaagcacgatccggcggctgtcgactcatttcggacatttgcttgcggcgatcgcaagccgtccggatgcgaagattgccgagctgaacttgctgacggcagaggaaaaagagcaaattctcggcgcgttcaacccggcgcagctggaagcggctcctgcggccgcgttccaccggctgtttgaggaacaggtggagcgcacgccggaagaggcggccgtcgtgtacgagaatgagcggctgacgtatgcggagctgaacgagcgggcgaaccgcttggcggctacgctgcgcgcaagcggcatcggccgggagacgatcgtcggcattctcgccgagcgttcggtggacttgctggtggccgtgctggccgtctggaaagcgggcggggcgtatgtgccgctcgacccggattatccggcagaccgcgtgcggttcatgcttgaagacagcggagcgaaggtgctgctgacgcaaacggcgctgcgagagcgtgccgaagcctggctcggcgaagaggagctggcgctggcggcggtgctgtacctggacgacgaagcgtcgtacaacgaggagcgggcgaatgcgccggttggctccggcatggtctccggcaagctgacggatgctgtggacgacggcgatgagagccatcagaatgtcgacaccgacggcttccatgaagcccgtccagaggacctggcgtacgtgatctacacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgttcgacgtgttcgtgggagatatcgcgcggacgctgtacaacggaggtacgatggtgattgtgccgaaggacgatcggattgatccgtctcgtctgcaccactggatggagcgggagcgggtcaccatcttcgaatcgacgccggcgctgatcgtgccattcctggagtacgtgcacgagcagcggctggatatgagctggatggagctgttgatcacgagctcggacagctgcagcgtggcggattaccggaccttgcaggaacgcttcggctcgttgttccggatcatcaacgcctacggcgtgacggaagcggcgatcgactccagcttctacgacgaggagctgacgaagctgccgcagacaggtcatgtgccgatcggcaaagcgtggctgaatgcgaaattctacatcgtggacgcgcatctgaacccggtgccggtcggggtgctgggcgagctggtcatcggcggagtcggagtggcgcgcgggtacttgaaccgtccggagctgacggaagagaagttcgtagacagtccgttcgccgcgggcgagcggctgtaccgcacgggagacttggcgcggtggatggaggacgggaacgtggacttcatcggccggatcgacaaccaggcgaaaatccgggggtaccggatcgagacgggcgagatcgagtcgcagctgctgcgggtggaaggcgtgcgcgaagcagtggtgctggttcgaagtgacgcgaacgggcagaaggcgctatgcgcgtattacacgccggataccggagcggagctggcggtgaacgatttgcgcggcgcgctggcgcaggagctgccgggctacatgatcccgtcgtacttcgtggagctggagcgtctacctctgacgccgaacggaaagattgaccggaaggcgctgccggcgccggaaagggaagcgggaagcggaacggagtacgtcgcaccgcgcaatgagctggaaacgaagctgacggcgatttggcaggaggtgctggggcttgcgaaggagattggcgttcacgacaacttcttcgacatcggcggccactccctgcgagcgacgacgctggtcagcaagattcataaagagttgaacgtggatctgccgctgcgcgacgtgttccgccattccactatcgagagcatggcggccgccatttcccggctggatgagcagacattcgttgccattccggtggcggatgaccgagaggtgtacccgcaatcttttgctcaaaaacgtctctttatcctgaatcaactggaaggcgcagagcttagctacaacatgccggaagcgatgctgctggagggtgctttggaccggacaaggttcgaagaagcgttccgtaagctcgtggcgcggcatgaaacgctgcgcaccgggttcgaaatggtggatggcgaagcatcgcagcggatttaccaggacgtgaattttgccgtggagttctatcgagtggatgagcaagaggccgaagagacggttcaccgtttcgtccgtccgtttgacttggcgaagcctccgctgctgagggtaggccttgtcgagctggctccggaacgccatattctaatgtacgacatgcatcatattatttccgacggcgtctcgatggaaatctttgttgaagaattcgtccgcttgtacggcggcgagcaattggagcctctgcgcattcagtacaaagactacaccgtttggcagcattcacaggagcagaaagaacggcttcagcgtcaggaggcgtactggctggacatgttccaaggcgagcttccggtgctggaaatgccgaccgactatccgcgtccggccgtgcagagctacgaaggccaaacgctggagtttttcttcgacgcttcgaaaaccgacggcctgaagcagctggcctcggaaacgggcacgacgctgtttatggtgctgcttgcggcgtataacgtccttctgcataaatattcaggtcaggaagacgtgatcgtcggtacgccgattgccggaaggaatcatggagatgtgcagccgttgatcgggattttcttaaacacgctggctatccgcagttatccggcttcggagaagacattcctgtcatacctgaacgaagtcaaagaaacgaccctccacgccttcgagcatcaaaactatccgttcgaagaattggtggacaaggtgcaagtcacccgtgatttaagccgcaatccactcttcgacacgctgtttacgatgcagaatacggagaacgaggaatttgagctggaagggcttcgcctgattccttatccgagcgcactggataccgcgaagtttgatatcagcttggatgtgggcgaggagaacggcggcttggattacagcttcgaatatgcgacggctctctacaaaagggagacgatcgaacggctggcgaaacattacgagcagctgctcgtaacgatcgtaagccgtccggatgcgaagatcgccgagctgaacttgctgacggcagaggaaaaaggacaaattctcggcgcgttccacccggcgcagctggaagcggctcctgcggccgcgttccaccggctgttcgaggaacaggcggagcgcacgccggaagcggtagccgtcgtgtacgagaatgaccggctgacgtatgcggagctgaacgagcgggcgaaccgcttggcggctacgctgcgcgcaagcggcatcggccgggagacgatcgtcggcattctggccgagcgttcggtggacttgctagtggccgtgctggccgtctggaaagcgggcggggcgtatgtgccgctcgacccggattatccggcagagcgcgtgcggttcatgctcgaagacagcggagcgaaggtgctgctgacgcaaacgccgctgcgagagcgtgccaaagcctggctcggcgaagaggagctggcgctggcggcggtgctgtacctggacgacgaagcgtcgtacagcgaggagcgggcgaatgccgacagcttccatgaagcccgtccagaggacctggcgtacgtgatctatacgtcgggaacgacgggcaagccgaagggcgtgatgatcgagcaccgcagcctggtgaacacggcggcgagctaccggcgggaataccggttggatcagttcccggtgcggctgctgcaactcgccagcttctcgttcgacgtgttcgtgggagatatcgcgcggacgctgtataacggaggtacgatggtgatcgtgccgaaggacgaccggatcgatccgtctcgtctgcactactggatggagcgggagcaagtgacgatctttgaatcaacgccggcgctgatcgtgccgtttatggaatacgtgcacgagcaagggctggatatgagctggatggaactgttgatcacgagctcggacagctgcagcgtggcggattaccggaccttgcaggaacgcttcggctcgttgttccggatcatcaacgcctacggcgtgacggaagcggcgatcgactccagcttctacgacgaggagctggcgaagctgccgcagacaggccatgtgccgatcggcaaagcgtggctgaatgcgaaattctacatcgtggacgcgcatctgaacccggtgccggtcggggtgctgggcgagctggtcatcggcggagtcggagtggcgcgcgggtacttgaaccgtccggaactgacgggagagaagttcgtagacagcccgttcgccgcgggcgagcggctgtaccgcacgggagacttggcgcggtggatggaggacgggaacgtggacttcatcggccggatcgacaaccaggcgaaaatccggggctaccggattgagacgggcgagatcgagtcgcagctactgcaggtggaaggcgtgcgcgaagcggtggtgctggttcgaagtgacgcgaacgggcagaaggcgctatgcgcgtattacacgccggataccggagcggagctggcggtgaacgatttgcgcggcgcgctggcgcaggagctgccgggctacatgatcccgtcgtacttcgtggagatggagcgcctgcctctgacgccgaacggaaagattgaccggaaggcgctgccggcgccggaaggggaagcgggaagcggaacggagtacgtcgcaccgcgcaatgagctggaaacgaagctgacggcgatttggcaggaggtgctggggcttgcgaaggagattggcgttcacgacaacttcttcgacatcggcggccactccctgcgagcgacgacgctggcgggcaaggtatttaaggaattaaacgtcaacctgccgctgcgcgacgtattccgtcactcgacgattgcggcgatggccgaggcgatcgcccggatggaacggcgggagcatgaggccattcctcaagcggaggagagagagtactaccctctgtcctccgcgcagaaacggctgttcattcagcacacgctggatggagcggatcagctttacaacatgccggagctggtgcaggtggaaggcgagtttgatttagaacggttggaagccgccttgcggaaattgataacacggcatgaatcgctgcgcaccggttttgaaatcgtgaagggcgaagcggttcagcggatttacccgcaggtcgattttgctatcgagcattatcaagcggataaagaggatgcggctcaaatcgagcagatcgtccgcagcttcgttcgtccgtttgatctcggcaagccgccgctgctgcgcgccggggtcatcgagctggagccgaacctgcatattctccttttcgacatgcaccatatggtgtccgacggcgtatcgatggcgattgtgatcgatgagttctcgagtttctacgccggggaagaactgccgccactgcgcattcaatacaaggattatgccgtttggcagcagtcgaaggcccaccgagagcggatcgggcggcaggaagcgtactggctgcaaaccttcgaaggcgagctgccgacggcagacctgccgatggactacgaacggtctgcggctcgcagctacgaaggcgcgcatctggagttcgacgtcgaagcttctctctctgcgcagctgcgcgaattggcggccgagcgtgaaagcacgctgttcatggtgctgcttgcggcttataccgtgctgctgtccaagtacagcgggcaggaggacttggtcgtgggcaccccggtggcgggaagaacgaacgccgatttggaaccgatcatcgggatgtttgtcaatacgctggcgatccgcaatcgtccgtcgggcgacaaaacgttcttgtcctacctggaagaagtgaaggaaacggctttgggtgctttcgagaaccaggattatccattcgaggagcttgtggagcgtttgaatgtgaagcgggaaccgggccgcttcccgctgttcgatgccgttttcgacttgcaaaatatcgaagaacgagacgccgagctggaaggggtcagcctgaagacttacgagcttgaccatttggaagaagcgaagttcgatctgacgctgtttatgtatgaaaacaatggggcgctgagcgggggcttcttctacgccaccaagctgttcaaagaagcgatgatccgcaccttgaccgaggattacctgcgggtactgtctcaaattgcgaaaaatccacaactcgagctaagccggatagaatgtcataaaccggcggcaggcgcaaagagtgccgtcgatacgatcgaattcgcgttctaa

SEQ ID NO: 2 - DNA, 3309 bp, Paenibacillus polymyxa E681
atgaaatctttgtttgaaaaggaagaacagtactggagcggtaagtttgacgccgatgacagcctgagcttccttccctacagtcaatcctccaaattatccgcccacggggaagctgcggccgagccgggcttgcttcaccgtactctgccgagtcaactctcggagagaatcattagcctcgccaacggttcggatttggctttgtacatgattgttttggcaggagtaaaaagcctgctgttcaaatataccgggcgggaccaagtgctggtcggcatgccttcttatagcgcagaccccgacgggactccgccgccgcatgacatcttggtgatcaagacgtccgtaagccgccagactacgctgaaaacgctgctcgggggcatcaaagcctccatcggcgaggcgctggagcatcagcacctgccttttcggaaaatggtggagccactccatctggactatacgggggacggcctcccggtcgttaacaccgtcgtatccttcgccccgattcatccggaaccgcaaggtaatcgggtggcggccgatacggtttttcgcttcgaccgccaaaaccactccatcgagctggaaataagctttgacgggcagcggtacgagcgggcatttgtggaacaggcggccgaccatcttgttcggctgctgtccgtgcttttatttcagccggatctgaagctgggacaagccgatgtgctgtcaccagacgagagggagacgctgctgaaacgatttaatgacaccgaaaccgagttcgagcgggggaaaacgatttacggcttgttcgaagagcaggcggagctttacccggacaacgtggccgccgtcatgaacgagcggcagctgacctaccgcgagctgaacgagcgatccaaccgccttgcgcggaagctgcgtgaggcgggagtagaagcggaccagctggtagcgattctggccgaacgctcgctcgatatggtcgtcggcattctggcgattctcaaagcgggcggagcatacgtgcctgtcgatcccgactacccggaggagcgtatccgcttcatgatcgaggattcgggcgcgccgttattgctgattcaaaagcatctgcacgagaagaccgacttcgcaggaacgcgcctcgaattggacgatttcgtttggggcgacagaggggcgaactccgccgaagcgctggacgcttcgaacctggagccgatttccgggccgggcaacctggcatatgtcatctacacgtcgggaacgaccggcagaccgaaaggaacgctgatcgagcataagaacgtcgtgcggctcctgttcaacgacaagaatctgtttgacttcgggccgtccgacacgtggacgctgttccactcgttctgcttcgatttctccgtctgggaaatgtacggagcgctgctgtacggaggcaagctggtcatcgtaccgccgctcacggcgaaaaatccggccgatttcctggcgctgctgggccgcgaacaggttaccattttgaaccagacgccaacgtacttctaccagctgctgcgtaaggtcttggcggaccatccgtacgatctgcggattcgcaacgtcatcttcgggggcgaagcgctgagtccgctgttgctcaagggcttcaagacgaagtacccggagacgaagctgattaatatgtacggcattaccgagacgacggttcacgtgacgtataaggaaatcacgtgggtcgaaatggaggcggcgaagagcaatatcggcaagccgatcccgacgttgagggtgtacgtcctggatgaaaaccgccgccttgtgccgatcggcgtagcgggcgaaatgtacgtggccggggaaggccttgcgagaggatacctgaaccgtccggatctgacggcggagaagttcgtcgattccccgtttgcggagggggagagactataccgctcgggcgacttggcggcttggctgccggacggcaacatcgaatacctgggccggatcgaccaccaggtcaaaatccgcgggtaccggatcgagctggacgaaatcgagacgcagcttctgaacgcccggggcgtggaagaagcggtggtgctcgcccgcgacgacgcgcacggccataagcagcttgtcgcttattacgtcgcggaaacgaggctggcggcgaatgaactcaaggaggagctcgccaagcagcttccagggtatatgattccttcgcacctcgtgcagctttcgcggatgccgctgaccccgaacgggaaaatcgaccgcaaagcgctgcccgcgccggaggaagccgcggccggaggagcggaatatgtcgcgccgagaacgctgctcgaaatgaagatcgtccgcgtctggcaggatacgcttggcgttccgcaggtcggcgtaaaggataacttttttgagttgggtggcaattcgttaagtctgatgaggctcgttcaagccgtttacgatgaaacgggcattgagataccactgaaccgccaattccataatgtaacagttgaagccatggctttcggagagggggatctgggcctggataaagggggagactccttcattaagctgaataaagcaggagatctgaacgtgttctgcttccctccgggcagcggcttcggcatcggttaccgggagctcgcaagcaggctcgacggccggttcgtgctctacggcattgattttatcgacgatgccgccgattacgaagccatgctgaaccgttatgtggacgagatcgtccgcatccagccggaaggaccttacgtgctgctcggctactgctttggaggcaacctgatgttcgaggtagccaaaacgatggagaaaagagagtattccgtaacggacgtgctcatggtggactcgtggattaaggacacgctgacgccttccgaaacgtcggagaaagagcttgaagaaacgcttgccgatttcgacgaagaagagaaggaattaatgagcaacccgctcgtgcgggagcgtgttcatcggaaggtcaaagcgaccttggcgtacgaagcgcagcttatgaattccggcacgatcccggccaggatttacgaactgattgcgaaggacagcgaagcgttccgcctggagcaccaattgccgtcctggcggggggcaacgacgcaagcttacgccgattaccggctggagggcgcgcacgaggaattgctggaactcgcgcgcgtggacgaaacggccgttgtcatccgggacatcttagaacaagtcaagcggcagatcgaagcggaggccggggtactgcatggaagctga

SEQ ID NO: 3 - DNA, 18939 bp, Paenibacillus polymyxa E681
gtgagagagaataccaaagagcaatatggattaacgcaagcccagcgccgaatatggttcatggaaattatgaatccgggaacgtccatcacgatgctttccgcgacctaccagattacgggcgagatcaacacacagcttctggagcaagcggcagcagagatcgtcaaaacctatgacgttttccgaatccgcattagcggggatttgcaaaatccaacgcagtggttcgaagagccggagaatgtccaggctaggataagccgcctcgaaataggcacaaccgaacaattctatgcttgggtgaaagaagtaagcgaaaaaccggccagcgtgttcgacgaacacctccaccaatttacgattatccattttgtgaacggccaagtatggctcaatttgacggtaaatcatattatcgccgacggcttgtccgtcaatgctttgctgcatgcggtgatggaaaaatacctggaactgcgcaaaggcatctccagcagttaccaggccccttcctatctggattatatttccgcggagcgtgaatatgagcaatcgcagcgttatcaaaaaggcaaggaatactggctgacgaagtacaacactttgcctgaaacgaccggcattaaatcgtatccgccattctcgatcggcagcgaatccaataaactgtccatcactttggacggttcccggtatgaacgcattctgaccttcagcgaacaatatcaggtcagcttatatacgttatttctgtccgccatgtacgccttattgtacaagctgaccgacagcatcgatgttccggtcggcacggttttcgccaatcgcaccagcaagaaggaaaaagaaacgattggcatgttcgtcagcaccgtggctacgcggattcgtctgaatccagacaggaacgtgctttccttgatccaaacggtttccaaggaaaatacggcggatctgcggtatcagaaatacccttataaccaattgatccaggatttacgtgaacaacacggccgcaacgatctttcggggctgttccgcacgtctctggaatatctgcctttgaaaatcgtggagtacgaagaaatcaaggtacgcctggaggctcactttgctaggcacgagatggacgatttgctgctgcgcttcgaccatatgctgaatgaaggccatgtcattctccatgcttcctatcgtaccggcttgttcgagacggccgagattgatcggattatggaacagtatgtaaccgttctggaccagtttcttcagactcccgaactgccgatacgcgagatttctctgctgagcgatgaggagagacaccgcattctcaacgtttttaacccgccggtggcagggctgagcgagggagaagcgtttcatcggtatgttgaaaagtttgctcgagaaattccagatcatccggcagtcgtctacatggacaaacagctgacctacggcgaattgaacgaacgcgccgagcggctggcttctctccttcgcgaacagggcgtgggaaaggagacgattacggggatctgggcggagcgttcagtggaactgctggtcggggtgctcgccgtttggaaagccggcggagcctatgtaccgctggaccccgattatccggcggagcggattgagtacatgctcagcgatagcgatgcatcggtgctgcttacgcagcgtcatctgttggagcgggccggaggttggttggccgatgaccggctgaagcttcaagctgtctatgccatggacgatgaacagatttataacggggatgccttagccgtggaatttgaatctgccggcagcgccccgcaagacttggcttatgtgatttacacctcgggtacgacgggacgcccgaaaggtgtcatgatcgagcatggtagtctcgtgaatacggcggatgcgtaccgtcgcgagtaccggttggatcagtttccggtgcggctgctgcagctggccagcttctcgtttgacgtgttcgtcggagacatcgcgcggacgctgtataacggaggcacgatggtgattgtgccgaaggatgaccggattgatccgaacctcttatacggctggattcgggaccaaaacattacggtattcgaatcgacgcctgcgctcatcctgccgttcatgcagcatatttatgaagaagggctggacgttagctccatgcagttgctgattaccagctcggatgcttgcagtgtcaccgattaccgattgctgcaggaaagattcggcggacaattccgcatcatcaacagctatggcgttaccgaagcggccattgacagcagcttttacggtgagccgctggataagctgccgccgtcgggtcatgtgccgatcggcaaagcttggctgaacgcccggttttacattgtcgatgccgcgttaaagccggttcctgtaggggttccgggcgagcttgtcatcggcggcgccggggtggcgcgcgggtactggaaccgtccagacctaaccgccgagaagtttgcggacagcccgtttgtgccgggcgaacgtctgtaccggacaggcgatttggcccgctggctggaagacggcaacgtcgacttcatcggccggatcgactatcaggtgaaaattcgcgggttccggatcgaactcggcgaaattgaaacggccctgctgcgtttcccgggcgtcaagcaggctgtggtgaccgaccgtacggatgagcagggggaaaagtatttgtgcggctacgtggcggcggatgcttccttgcagctgagcgatttgctgtcccaattgaagcaagagctgccggcccatatggtcccggcccggctggtgtctcttgataagcttccgctcacgccgaacggcaaaattgaccgtaaagcgctgcctgaaccgaccggagaggtagaagcaggccgtgagtatgtggctcctcgcacaacgctggaaacaagacttgctctcatttggcagcaggtgctgggtattgcgcgagttggagtccaagacgatttttttgacttgggtggtcattccttgcgggcctccacgctggtttccaagattcggaaagagctgcaagtcgaggttccgctgcgcgaagttttccgctacaccacgatcgaacagctggcccaaagaatcggcggtttaaggcagcaggagacgtatgagattacaaaggcggctgaggccgagtactatccggtttcatccgagcaaaagcgtctgtacgtcctgcgccagcttgacggggccgagcgcagctacaatatgtcggcggcgcttcttctcgaaggcaagctggaccgcatgcgcgtcgagcacgcgttccgggcgctgattcagcgccatgagacgctgcgtacgggaatcgagcaggttcaaggcgagcttgtccagcgcatctatgacgaggtcgagtttgctgtggattatttccaggcgagcgagcgggaagtggagcaagtggtggaagcttactatcacccgtttgatctgaccaagccgccacttctccgcatcggcctgatcgaagtcgccgaggatcgccacattctgctgttcgatatgcaccatatcgtctcggatggcatttcgacagcgctgctcttcgacgagttcagccgcctgtatcggggcgaggagctgggcccgctgcgcattcaatacaaagattatgccgtttggcagcattccgaagcttacgggcagatgctccagccgcagaaggagtattggctggaacagctgtcgggcgagctgccggtcttggagctaccgacggacttcccgcggcctgcggtgcaaagctttgacggtcgaaccgtgaagttttatatcgagaaagatcggacggagaagctgaaagagctggcggcacggacagggacgaccctgtacatggtgctgctgtcggcttacaccatccttatgcataaatattcgggtcaggaagatctgatcgtaggaacgccgattgccggaagaacgcaggaagaagtgcagccgatcgtagggatgtttatcaacacgctggccattcgcagccgtccggagcgttccaagccgtacctttcgtacctggaagaaatcaaggacatcacgctcggggctttcgaacaccaaaattatttgttcgaagacttggtggaaagtcttcatattccacgcgcgaccggccggaatccgctctttgacacgttcttctccctacaaaatacggagaacgagcaaattgtcatcgaggggctggagcaatcgttttatccgctggaaaaccaaacatccaagttcgagctgctcctggatatttcggagctggacggtcagctcgaatgccggttagagtacgctacggctttgtataaacaggagaccgcggagcggttcgccagacattatgacaagctgcttgaaaccatcgcagcagcgccggacggggatattgcctcgctggaaatgctcaaggaggaggaaatccgcgagctggtgcgcggtttcaacgattcggaggcggactacccgcggcagcagacgattcacggcttgttcgaagaacaggcggagctttacccggacaacgtggccgccgtcatgaacgagcggcaactgacctaccgcgagctgaacgagcgatccaaccgccttgcgcggaagctgcgagagacgggagtagaagcggaccagctggtagcgattctggccgaacgctcgctcgatatggtcgtcggcattctggcgattctcaaagcgggcggagcctacgtgcctgtcgatcccgactacccggaggagcgcatccgcttcatgatcgaggattcgggcgcgccgttattgctgattcaaaagcatctgcacgagaagaccgacttcgcaggaacgcgcctcgaattggacgatttcgtttggggcgacagaggggcgaactccgccgaagcgctggacgcttcgaacctggagccaatttccgggccgggcaacctggcatatgtcatctacacgtcgggaacgaccggcagaccgaaaggaacgctgatcgagcataagaacgtcgtgcggctcctgttcaacgacaagaacctgttcgacttcgggccgtccgacacgtggacgctgttccactcgttctgcttcgatttctccgtctgggaaatgtacggagcgctgctgtacggaggcaagctggtcatcgtaccgccgctcacggcgaaaaatccggccgatttcctggcgctgctgggccgcgaacaggttaccattttgaaccagacgccaacatacttctaccagctgctgcgtgaggtcttggcggaccatccgtacgatctgcggattcgcaacgtcatcttcgggggcgaagcgctgagtccgctgctgctcaagggcttcaagacgaagtacccggagacgaagctgatcaatatgtacggcattaccgagacgacggttcacgtgacgtataaggaaatcacgtgggtcgaaatggaggcggcgaagagcaatatcggcaagccgatcccgacgttgagggtgtacgtcctagatgaaaaccgccgccctgtgccgatcggcgtagcgggcgaaatgtacgtggccggggaaggccttgcgagaggatacctgaaccgtccggatctgacggcggagaagttcgttgattccccgtttgcggagggggagaaactgtaccgttcgggcgacttggcggcttggctgccggacggcaacatcgaatacctgggccggatcgaccaccaggtcaaaatccgtgggtaccggatcgagctggacgaaatcgagacgcagcttctgaacgtccggggtgtggaagaagcggtggtgctcgcccgtcaggacggcgggggcgagaaggcgcttgtcgcctactttgtggcggaccggacgctgacggtcagcgaaatgagaacctcgctggcccagggaatgccggggtacatgatcccgtcgtacttcgtgcagttggagcgcatgccgctgacgaccaacggcaaagtggaccgcaaagcgctgccggagccgcaaggcggcatacaaacgggtgtcgaatacgtagcgccgcgtaactggacggagtcccagcttgtgaagatctgggaggaagtgctgggttactccggcattggagtcctggacaatttcttcgagctcggaggccactccttgcgggcgacgaaccttgtcagcaagattcggaaggaaatgaacgtcgaacttccactgcgtgatgtgttccgctatacgacggtagagtcgatggccggggctattgccagcttggaagaaacacagcacagctcgattccgaaagcggaagagaaagcgtactatccggtttcctccgcgcaaaaaaggctgtacgtcctgcaccagctggatagctcggagctgaattacaacctcccaagcgccttgcaattggaaggggctttgaacgaggccaaagtggaaaaggcactgactactttggtggcccggcacgatatgctgcgcaccggttttgaaatcgtgaatggggagccggttcagcgtattcatccgctcgtagctttcaaggtcgagaagcttcaagcaagcgaagatcaggttgcggccattcttgaaggcttcattcagccttttgacttgacccagccgcctttgctgcgcgccctgctgatcgaactggagaaagagaaatttctgctcgcgctggatattcatcatattggttccgacggcctttccatggacgtgctgctgcgcgaattcgtgcggctttacaatggggaggaattgccggagctgcggattcaatacaaggattacgccgtttggcagcaatccgaggagcagcgccagcgcatcaaacggcaggaggaatactggcgcggggtattcagctccgagcttccggttcttgagctgcctctcgacttctcccgcccggccgttcagcagtttgacggtcaaacgctcacgtttacgctggatgcggagaaaagcgaagctctcaaacggcttgccggcgattcgggggcgacgctgtacatgcttctgctggctgcgtactccgtattgcttcataaatacgcgggacaggaagatatagtggtcggcactccgattgccgcccgttctcacgccgacctgcagccgattatcggcatgttcgtcaatacgctggcccttcgtttgcgtccggcggcggagcggacgttcctggattacttgcaggaagtgaaggaaacgacgcttggagcctacgagcaccaggactatccgttcgaggagttggtggaagctcttcaggtgagccgggatttaagccggaatcctctgtttgacaccatgttttctttgcaaaagcacgaaagcttggatttaaccctggaaggcttgcaatggtcgctgttcgacatcgaggaaaagacggccaagtttgatcttagctttgatatcgtggaagccgataacgagctggtttgcaagattgagtacgctacctcgttgtttagacaggaaacgatggtacggctggcgggacattatgagcagcttttggcgtccatcctggctcagccgggtgcgcggatttcggatttggatatcttgacggacagcgaaaagcatgatttgctggtcgggtttgacgtgtcgtcttcggctcttgcgaagcaacccgccgcagaaggtacaggtttggaagcggatgagtcgtggagagagagaacgttccacgagctgttcgaggagcaggcggagcgcactccgggagcgctggcggttgtctacgaagacagcaagctgacgtatgcggagctgaacgccaaagcgaatcgtctggcgtatgcactgcgggcgcgcggtgtgaagccggagcaggtggtcggcattctggccggccgttcagcagagctgttggttggtgtgcttgccgtatggaaagcgggcggcgcttatgtgccgctcgacccggattatccggcggaacggatcgaatatatgctcgcggacagcggggcgtcggtgctgctcacgcagacctgcctgctggagcaggcggaagcttggcgcagcgacggagctctagtgctgcaaacggtgcttgcgcttgacgacgccgcgacgtacagcctcggagcggcggaagcggctgtgggcgtacaagctttgggtgaagcaggcgcagaggcggaggctttggcgcaagcggaaacggctgctgccgaaaaatccgccacggcagaagccgagaagaacgtactagcggcggatctcgcatcgaatccggcgaatgtgaacaagccgagcgatttggcttacgtcatctacacctccggtacgacgggccgtccgaagggcgtggcggtggaacaccgcagcttggtgaacacggcggcgggctaccggcgggactaccgcctggatcagttcccgatccggctgctgcagctcgccagcttctcgtttgatgtgttcgtcggtgatattgcgcggacgctgtacaacggcggcactatggtcatcgtgccgaaggacgaccggattgatccaacccgcctctacggctggattcgcgactacgccgtgacggtgttcgaatcgactccggcgctgatcgtgccgttcatggagcatgtgcatgccgagggtctggatctcagctcgatgcagctgctgatcacaagctcggatgcgtgcagcgtagcggattaccgcaccttgcaggagcgcttcggctcgcagttccgtattattaacagctacggcgtaacggaagcggcgattgactccagcttctatgacgagccgctggagaagctgccgaagacgggcagcgtgccgatcgggaaagcgtggctgaacgccaagttctacatcgtggatgcgaatctgaagccggtgccgatcggggtgttgggcgagctggttatcggcggagcgggtgtggcccgcggttacttgaaccgcccggatttgacggcggagaaattcgtagacagcccgttcgccgctggggagcggctgtaccggacgggcgacctggctcgctggatgccggacggcaacgtggacttcatcggccggatcgacaaccaggtgaaaattcgcggctatcggatcgagcttggtgaaattgaagcggccatgaaaaattttgccggcgtgcgtcaagcgcttgtcatcgaccggacggacgagcgggggcagaaatatttgtgcgggtatgtcgtagcggattccagcttcgatctggaagggcttgtggcccatctcgacgccgcgctgccttcccatatggtgccttcgcgcatcatgcgcctggatcaaatgccgcttacgccgaacgggaagatcgaccgtaaagcgctgcctgtaccggaaggaagcattcgtgccgaggctgcatacacggcgcctcgtactcctgccgagcaagcacttgcgtcggtctggcagtcggtgctgggcgtggaccaggtcggcacgatggacaatttctttgcgctcggcggcgattcgatcaaggccttgcaggtatcgtcccgtcttttgcaaacggggtacaagctggtcatgaaagatttgttccattacccgacgatttccgcccttagtttgcagctgcaaacggcggagagaacggcaagccaggccgaagtgacgggagaggtcatcttgaccccgattcagcgctggttctttgaacaaaatccggccgacgtgcatcacagcaaccaggcgttcatgcagttctccaaggaaggctttgacgaagaagctttacgccaagcggtgcgtcagattgtcgtgcatcacgatgctctccgtacggtttaccgccaagccgacaacggctataccgcctggaaccgcggcgccggggagaacgaagcgctgttcgatctggaagttgtcgatttcaagggagtcggcgacgtgaaagaagcggtagaggctaaggcgaatgacattcaagcgagcatcgatctggaaaacggtccgctggtgaagctcggcttgttccgctgcgacgacggcgaccacctactcatcgcgatccatcacttggtcgtagacggcgtatcctggcggattctgcttgaggattttgctgccggctatgagcaggcgctgcaagggcagccgatccgtctgccgctcaaaacggattcattccaaacgtgggcgaaacagctcgctgattatgcgaacagcccggcgatggaaagcgagagagagtattggcagcatatcgagcaattgacctatgagccgcttccgaaagattttgaacaaggcagatccaagctgaaggacagcgggctcgtgaccgttcgctggacggcggaggaaaccgaacagctgctgaagcaggcacaccgtgcttaccatacggaaatgaacgatttgctgcttgccgcgcttggcctcgctttacaagcttggagcggccgggaacgcgtgctggtgaatctcgaaggccacggccgggaagatattttgccggatgtggacattacgcgcacggtaggctggtttacaagccaattccctgtcgttctggagccgggtcacgcccaggcgctcggtcatcaggtgaaacaggttaaagaaagcttgcgccgcattccgaacaaaggaatcggctacggcatcctgcgttatttgtcggcgccgcgtgaaggcgagtacttcgttttagagccggagatcagctttaactacctgggtcagttcgaccatgattacgaaagcagcagctcgcagccgtccccgttcagcccgggctccgactcaagcccgaatgctgtgatggattatgtccttgatatcaacggtatggtgtcggaaggagcgttggaactcacgatccgttatggggaaacccagtataaacgggaaacggtggagcgtctgggcaccctgcttcaatcgagcttgcgtgaagtcatcagccattgcttatcaaaagagcggccggagcttacgcctagcgacgtactgcttcaagatgtgacggtggaggaactggagcggctgtccgaacatacggtggcgctcggcgaactggagaatgtatacaccctgactccactgcaaaaagggatgttgttccacagcttgctggatgccgattcggaagcttacttcgaacaggtgaccttcgatctgtacggaagcctgaatgtggaagccttcacccgaggattggatacgctggtgcagcggaatgaggcgctgcggaccaactttattaccggctggagagacgagccgattcaagtggtattccgcgagcggaagtgtgaagtgtacttcgaagatattcgttcggtaagcgatgaacacccggagaagacgatagccgattttgtcagcgcggataaagcgaacaagttcgatctggcccgaggtcctcttatgcgtgtgaccgttgtgcgcacaggcgacgagtcctaccatgtgatctggagtcatcatcacattttgatggacggctggtgtatgtccttcatgatcaaggaagtgttcgacacctacttcgcgttccaggagaagcggacgctggagcttcctccggttacctcgtactcccggtatatcgaatggctggaagctcaagatgccgcgaaagcttcgcgttactggtccgagtatttggcgggttacgatcagcagaccaagctgccccaggagaaaacgcagctgaagcagggcgcttttgaagcggctgaaatcgatgtggaactcagcaaggaactgaccgggcaaatcgagcgggtggcgcgccagcagcaggtgacactcaatacgtttatgcagactgtatggggactggttctacagatatacaacaacagcgaggatgtcgtattcggctccgttgtatccgggcgtccggcggaaattccgggcatcgaaagcatgattggcctgtttattaatacgatcccggtccgtattcaaggtaaagccgaggagagggtagccgatatcttgagaaaaacccaggatcaagcgctggcatcgggagcatatgaaacgttcccactgttcgaaattcagtccctgagcgagcaaaagcgcgacctgatcaaccatattatggtctttgaaaattatccgatggaagaacagatcgagcaggtcgtcggtggaggccgagaagcgctgaaaatcgctaatatccagtcgccggagcaaacgaactacgacctggacattaccgtcattccggaagagcatattttgctgcggtttacgtacaatgcgctaacgttcagagaggatgacattaggcagatccacagtcattttgcctgggcactggagaaggttgcggctaacccgaacatcctcgtgaatcagttggagcttttgacggcggcggaaaaagagcaaattctcggcgcgtttaacccggcgcagccggaagcggctcctgcggccgcgttccaccggctgttcgaggaacaggtggagcgcacgccggaagaggcggccgtcgtgtacgagaatgaccggctgacgtatgcggagctgaacgagcgggcgaaccgcttggcggctacgctgcgcgcaagcggcatcggccgggagacgatcgtcggcattctcgccgagcgttcggtggacttgctggtggccgtgctggccgtctggaaagcgggcggggcgtatgtgccgctcgacccggattatccggcagaccgcgtgcggttcatgcttgaagacagcggagcgaaggtgctgctgacgcaaacggcgctgcgagagcgtgccgaagcctggctcggcgaagaggagctggcgctggcggcggtgctgtacctggacgacgaagcgtcgtacaacgaggagcgggcgaatgcgccggttggctccggcatggtctccggcaagctgacggatgctgtggacgacggcgatgagagccatcagaatgttggcaccgacggcttccatgaagcccgtccggaggacctggcgtacgtgatctatacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgttcgacgtgttcgtgggagatatcgcgcggacgctgtacaacggaggtacgatggtgattgtgccgaaggacgatcggattgatccgtctcgtctgcaccactggatggagcgggagcgggtcaccatcttcgaatcgacgccggcgctgatcgtgccgttcctggagtacgtgcacgatcagcagctggatatgagctggatggagctgttgatcacgagctcggacagctgcagcgtggcggattaccggaccttgcaggaacgcttcggctcgttgttccgaatcatcaacgcctacggcgtgacggaagcggcgatcgactccagcttctacgacgaggagctggcgaagctgccgcagacaggccatgtgccgatcggcaaagcgtggctgaatgcgaaattctacatcgtggacgcgcatctgaacccggtgccagtcggggtgctgggcgagctggtcatcggcggagtcggagtggcgcgcgggtacttgaaccgtccggaactgacgggagagaagttcgtagacagcccgttcgccgcgggcgagcggctgtaccgcacgggagacttggcgcggtggatggaggacgggaacgtggacttcatcggccggatcgacaaccaggcgaaaatccgggggtaccggattgagacgggcgaagtcgaagcaaagctgctgagtgtaggtggcgtgaaggaagcggtcgtcgtcgtcagggaagatcaagaaggtcagaaagctttgtgcgcttattatacagcggaagaaggcttgacggcggcggatctgaagcgggcgattgccagcgagctgccggggtacatgatcccgtcgtacttcgtggagctggagcgcctgcctctgacgccgaacggaaagatcgaccggaaggcgctgccggcaccggaagggggagcaggcggaggccgcgaatacgtggcgccgcgcaccgaacttgaggcgaagctggccgccatttggcaggatgtgcttgttcgggagaaggcggtaggcgtaacggacaacttcttcgacctcggcggacactccctgcgggcaacgacgcttgtcagcaaaatgcataaggagctaggcgttgaattcccgcttcgcgacgtattccgctacccgacggttgaggaaatggccgcggctatggagcggctggagatcggctcgttcatggctattccggctgcggaacctagcgagtattatccgctctcttccgctcagaaacgtctctatatcttgaaccagctggaaggagccgagctgagctacaacataccgggagctatgctgctcgaaggggagctcgaccggcagcggtttgaagaagcgttccgcgggctcgtagctcgccatgaaacgctgcgtaccggctttgagatggtaaaaggcgaagcggttcagcggatttacgaagaagccgccttccaggtggaatatgtgcagatcagcgcggagcaggcggaagaaacggtgcgccaattcgttcgtccgtttgatctagcgaagccgccacttctgcgggtaggccttgccgaactggcgccggaccggcacattctaatgttcgatacgcatcatatcgtatctgacggcgtttcgattgatgtactgatcgaagagttggtccgcttgtacagcggggagcagttggagccgctccgcattcagtacaaagattatgcggtatggcagcaatcggacgagcagaaagctcagcttgccaagcaggaagcctactggctcgacatgttccgcggagagctgccggttttggaattgccgacggactatccgcgcccggctatgcagagctacgagggccgcacgctgcaattgtttatgcatagcgagaaaagcgagggtctgaaacggcttgcagccgagaacggcgcaacgctttacatggttctgcttgctggttatacaatattattgcataaatatacaggacaagaagacgtggtggtcggtacgccgattgcgggaagaaatcacagcgatgttcagccgctgatcgggatgttcgtcaataccctggccatccgcagttatccggctgccgataagacgttccttgagtacttgaaggaaatcaaggagacgacgctgggcgcttttgaacatcagaattatccgtttgaggaactggtggataaggtgaacgtggctcgtgatttacgccgcaatccgctgttcgatacgatgtttgctttgcagaatacagagaatttggaaatccagcttcccggactccatttgtcgacgtatgccagcgaagaaattgtttctaaattcgatctcagcttggacgtcacggagatcgaggaaggcttggaatatctgtttgaatacgccactgctctttataaaaccgaaacggtggagaaattggccgctcactacttgcagctgcttgaatccattctccgcaacccatcggcgactattgccgagctgggcattttgacaccggcggaaaaagagcaaattctcggcgcgtttaacccggcgcagccggaagcggctcctgcgaccgcgttccaccggctgtttgaggaacaggtggagcgcacgccggaagaggcggccgtcgtgtacgagaatgaccggctgacgtatgcggagctgaacaagcgggcgaaccgcttggcggctacgctgcgcgcaggcggcatcggccgggagacgatcgtcggcattcttgccgagcgttcggtggacttgctggtggccgtgctggctatctggaaagcgggcggggcgtatgtgccgctcgacccggattatccggcagaccgcgtgcggttcatgcttgaagacagcggagcgaaggtgctgctgacgcaaacgccgctgcgagagcgtgccgaagcctggctcggcgaagaggagctggcgctggcggcggtgctgtacctcgatgacgaaacgtcgtacagcgaggagcgggcgaatgcgccgattggctccggcatggtctccggcaagctgacggatgctgtgaacgacggcgatgagagccatcagaatgttggcaccgacagcttccatgaagcccgtccggagaacctggcgtacgtgatctatacgtcgggaacgacgggcaagccgaagggcgtgatgatcgagcaccgcagcctggtgaacacggcggtgggctaccggcgggaataccggttggatcagttcccggtgcggttgctgcagctcgcaagcttctcgttcgacgtgttcgtgggagatatcgcgcggacgctgtacaacggaggtacgatggtgattgtgccgaaggacgatcggattgatccgtctcgtctgcaccactggatggagcgggagcgggtcaccatcttcgaatcgacgccggcgctgatcgtgccgttcctggagtacgtgcacgatcagcagctggatatgagctggatggagctgttgatcacgagctcggacagctgcagcgtggcggattaccggaccttgcaggaacgcttcggctcgttgttccgaatcatcaacgcctacggcgtgacggaagcggcgatcgactccagcttctacgacgaggagctggcgaagctgccgcagacaggccatgtgccgatcggcaaagcgtggctgaatgcgaaattctacatcgtggacgcgcatctgaacccggtgccagtcggggtgatgggcgagctggtcatcggcggagtcggggtagcgcgcgggtacttgaaccgtccggaactgacggaagagaagttcgtagacagtccgttcgccgcgggcgagcggctgtaccgcacgggagacttggcgcggtggatggaggacgggaacgtggacttcatcggccggatcgacaaccaggcgaaaatccggggctaccggatcgagacgggcgagatcgagtcgcagctgctgcgggtggaaggcgtgcgcgaagcggtggtgctggttcgaagtgactcgaacgggcagaaagcgctgagcgcgtactacacaattgatggcgaactgacggcggcagacctgaaacgggcgatctccagcgagctgccgggttacatgatcccgtcgtacttcgtggagctggagcgcctgcctctgacgccgaacgggaaaatcgaccggaaggagctgccggcgccggaagggggagcaagcgcaggccgcgaatacgtggcgccgcgcaccgaactggaggcgaaactggtcgccatctggcaggacgtgctcgggccgatcacgattggcgtgacggacaacttcttcgacctcggcgggcactccctgcgggcgacgacgctggtcagcaaggtgcacaaggagctgagcgtggacctgccgctgcgcgatgtgttccggcactcgaccatcgaagcgatggccgaagcgatcagccaattggagcggcaggaacacctctccattccggttctggataagagggattactatccgctttcctccgtgcagaaacggctgtatatccagcagcagatggaaggcgccgagcttagctacaatatgtccggcatgacggttctcgtcgggcgtttggaacggaatcaattcgaggcggcgctcaaaggattgatagctcgtcacgaaattttgcgaaccggcttcgaaatggtcgacggcgaaccggtacaacggatttatccggacttgaagtttgccgtcgagtatacgaaagcgatggaaagtgaaacgaagagcatcgtagacggctttgtacgcgtctttgatttggagcggccgccgctgctgcgtgtgggcttagtcgaaatggaagcggaacggcatctgctcatgctggacattcatcatatcgtcacggatggcatgtcgatgggcatcttcgtcgaagagctactgcgcctgtataacggcgagactctggaaccgcttcggattcaatacaaggaattcgccgcttggcagcagtccgaacctgtaaaagagcggctgaaacgtcaggaagcctactggctggacgtgctggaaggcgaattgccgacgcttgaactgcctacggactttgtcagacctgccgctcgcagctttgagggagatgtgctgcctttcagcatcgacaagcagatgaccgacagcttgcagcgcatcgccgatgagaacggtgccaccctttatatggtgttattggcggcctattcaatcctgctcagcaagtactcgggacaagaagacttcattgtaggcacgccggtttcgggccgcacacatgccgacctggagccgctcataggaatgtttgtcaacactttggcgattcgccattatccgtccggggagaagacgttcctcgcttacttgaacgaagtcaaagaaacaatgctgggggcctacgagcaccaggattatccgttcgaggagcttgtgaaaaagctgcaggcaccgcgagatcaaagccgcaatcctgtattcgatgtcatgtttgctctggaaaccaaggaagataacgttcaaagcttcggggatatcaagatcgaatcttatccggaaactcatacggtttcccaatttgatcttaccttggtcatttcgttgctggatgagggaatgaacgggcagtttgaatatgccaccaagttgtttacgcgcaatctgatcgacaatttcgctcaggacctgctcgtgatcatcacccaaatttgcgaacagccttcggcgctgttgaaggatatttccctgaacgggcaatccgaacaggagcaagatgtgctagaggccattgatattattttctaa

SEQ ID NO: 4 - DNA, 14880 bp, Paenibacillus polymyxa F4
atggcttttgaaaaagaaacgttgttttggaacgaaaaattcggtagcgacgattataccttgacgcggctgccttacagcaaagctccaagctccctggcgcccattatgacaaccgtcggcgggacgctttcggaggaagtggcgcagcgcgtccttcaaatgagcaagggcgctccgctggccacttttatgattttgctcgctggtgttcagtcgctcttgcataaatatacaggcgcttctgacattctggtcggcatgccggttgtacggaaaccgacggagacgcgccgatccgttaatcatacgatcattttgaaaaactcgctttcggcgggtgcgacttttaaaacgcttctgagcgagctgaggacttccttgccggaagcgattcagcatcaacatattccgttcttgaaaatgacggagaagctggacctgcaatatgcaggcgggatacccgtcgtccatacgctagtatcccttaaggagctgcatctggacgaaatcgggcaaaacgtggtcacagattgttcctttgaattcagcttaaccggcgggacgatacagctagcgctgtcatataacgagcacttatatgactccgagttcatgactcgggtcgtcggccatctgaatcgcctgctggccgtggggcttcacgagttggagctggacatcgtgcgggcggacatgctgtcggaggacgagaaatttcaattgctgcaaagctttaacgataccgagaaggactatccccgtgatcggacgattcatcagctcgtggaggagcaggcgaagcgggtgcccgaagcgacggcggttgtctttgaggggcggcggctttcgtacgcggagctgaacgaacgggcgaaccggctggcgcggacgctgcgatcggtcggcgtgctgcccaatcagctggtaggcatgatggccaggagatcgctggagacggtcgttggcattctagcggttttgaaagctggcggtgcctacgtgccgatcgacccggaatacccggaagaacgcatccgctacattctggagaactcgaacgcgcagctgctgctgactcaaagggagttgctgcagcaggtgccgttcgaagggaccgtggtggcgctggatgacgagcaggcctacagcgacgatggctcgaacctggagccggccagcggtccgaacgatctggcttatgtcatctatacatcaggtacgacgggcaaacccaaaggggtcatgctggagcatcgcgggctggtcagcctgaaactgacgtttgcccatacgcttcacacgaccgaacaggatcgagtgctgcaattcgccagcctatcgttcgatgcgtcgtgctgggagatgttcaacgctctgtattttggggcgaccttatatataccgtcaaccgagacgattttggatgatcagctgttcgaacgtttcatgaacgagcatgcaattacgatcgccactttgccgccaacttatgcggcttatttgaattcagaccgcctgccgagtctgagcaggctcatcacggcgggctccgccgtttcagccgaattcgtgcagcagtggaaagacaaggtacagtactataatgcgtacggtccgacggaagcctcgatcgccacatccgtgtgggcggcgtctacgcatgacaccgaacgcagagcgataccgatcggacgtccgatctggaaccatcgcttgtatatactgggcgcacagaatcagctggcgcctatcggagtggagggagaattatgcatcgcgggcgtcggcctcgcccggggatattggaaccggccggatctgacggcggagaaattcatcgaacacccgtttgagcccggagagagactgtaccggacgggcgacttggcccgctggctgccggacggaaatattgagtacttgggccggattgaccatcaggtgaaaatccgtggattccggatcgagatcggcgagattgaagagcagcttctgaagatcgactccgtgcaggagacgatcgtaatcgcgcgggaaggcaaaagcgggcaagaactgtgcgcttacctggtcgcggggcgcccgcttacgctcggcgagctaagaagcgcgctggcgcaaaaattgccgaattacatgattccggcgcattttgttcagcttccgcagatgccgctcacgccgaacgacaaaatcgaccgcaaggctttgcccgctccggaaggaaacgcgctgaccggcggcgcgtacgtagctccccgcaatgaagccgagcggacgcttgccgatgtgtggcaggcggtattgaacgccgatcgcgttggggtaacggatcatttcttcgagctgggcggagactcgatcaagtccattcaagtatcttcgcggcttcatcaagccgggtacaagctggaaatccgggatttgttcaaatatccgactatttcacagctcagcctgcatgtgaaaccgatcggacgtaccattgatcaaggcgaaataacgggtgaaacggcgctgatgccgattcagcattggtttttcgagagctcctttgcggacccgcatcatttcaaccagtcggtgatgctgtaccggaaggaacgcttcgacgaagagacggtgcgtcaggtgctgcaaaagctggccgagcatcatgacgccttgcggatggtgttccgcaagacggaacaagggtttagcgcgcggaaccgcgcgattcaggaaggcgggctgttcacgctggacgtgttcgacttcaaggatgcggagaataccgcgcaggctgtggaagcgaaggcaacggacattcaagcgggcatcgatctggagaacgggcccctcgcgaaggcgggactgttccggtgcgcggacggcgatcatttgctgctcgcggttcatcatgccgtggtggacggcgtgtcttggcgcattttgatggaggatttcgctctgggttacgagcaggccggcaaaagcgaggaaattcgtttcccggcgaaaacggatgcgtaccgcacttggtccgagcagttggccgcttacgcgcaaagcccggagatggcgaaggaacgggcctattggcaggccgtggaacaaattgcggttccggccgtgccgaaggatctggaggcggacgttacgacgcagcaggacagcgaatcgctgttcgtccgtttgactcccgaagaaacggagctgctgctgaagcgggttcaccgggcctacaacaccgaaatgaacgatattttggtaacggcgctcggcatagccgttcgcaagtggacgggacacgaacgggtgcggatcaatctcgaaggacacggacgcgaatcgatcggaacggatatcgacatcacgcgcacagtcggctggtttacgaccaagtttccggtcgtcctggagccggaaaccgaccgggatttggcctatcagattaaacaggtcaaggaaagcttgcgccgcattccgaacaaggggcttgggtacggcgtatgccgctatctctccaaatcggaggatggctttgtttggggcgcagagccggaaattaattttaactacctcggccagttcggcgatgatgtcaatcaggacgagatcggcatatcttcttattccagcggcagcccggccagcgaccggcaggcccgcagctttgtgctggatatcaacggcatggtgctggacggcgctttatcgctcgatctcagctacagccggaagcagtatcgcaaggaaacgatggaagccttcgctcagcggcttgagcaaagtctccgagagctcattacccactgcgcaggcaaagaaaacaccgaattgacgccgagcgacgtgcaatttaaaggcttgaccatcgcggaattggagcaaatcgcccagcgctcgggccatctcggggaaatcgaaaatatttactcgcttacgccgatgcagaagggcatgtggttccacagcgcgcttgaccggcaaacggccgcttacttcgagcagacgcggtttacgatgcggggagcgctcgacgtccagcttttcgagaggagctggatggagcttgcgaaacgtcatctggtgctgcgggcgaattttgtgaaaggaccggcgggcgagccgctgcaaatcatataccgcgacaagccggtcggctttgaatatgaagagctgcttcatttgcaggcggacgagaaacaagcgtatttggataaaaaggcggaggatgacaagcttcgcggcttcgacatggaacatgacgcgctcgttcgggttacgatcctacgcaccgaagagcaaagctatcatgtgctgtggagtttccagcatattttgatggacggctggtgcctgccgcagctgacgcaggagctgtttgagacgtactcggccttggcatccggcaagcagccagcgggagataagggatcggattatggcgcttatatcgaatggttggagaaacaggacgatcaggcggcatccggctattggacggcattcctggcaggttatgaagggcaaaccgtactcccgggacaaaaggaaccggcgccaaacggcagatttacggctgatcacgtcaccgccgagctgggcaaggacttgagcgagcggatggaccgggtggcgaaacagcgcctggttacggtcaatacgctgctgcaagccgcttggggcgtgatgctgcaaaaatataacggaacaaacgatgccgtattcggcagcgtcgtggccggaagaccggcggaaatcccgggcatcgagtccatgatcgggctgttcatcaatacggtgccggtccgcgtcacgagcgaagcggacaccgtgttcgccgacctgatggcgaagctccaagagcgggcgctggagtccgggcgttatgattactatccgctgtatgaaattcaagcccgcagcgtgcaaaagcagaacctgatcaaccatatcatcgctttcgagaactatccggtggacgagcagatggagcaggcgggcgaccagcagcacggcgacctgacgatcgctgacgttcagatggaggagcagacgaactataacttcaacgtgaccgtggtgccgggagtcgagatcgaaattcgattcgactttaacgccgaagtgttcgataaagacagcatcgagcggctcaaggggcatctcgtccatctgctggagcaggtgacggataacccggaaattaccgtgggcgagctggaacttgtgacggaggcggaaaaggccgaccttctcggacgttttaacgacaccaccacggaatttccgcgcgggaagacgctcattcaattgttcgaagagcaggcggagcgcatcccggatgcagccgctatctccttgaatgagcaagagctgacctaccgcgagctgaacgaacgcgtcaaccgccttgcccgtaccttgcgtagccacgggatatccaaaggccgtctggtcgccattatggctgagcgttccatcgaaatggtggtgggcatgctggcggcacacaaagccggagcggcttacgtaccgattgacccggaatatcccgaggagcgtatccgtttcttgattgaggattcgggagcgcaggtcatgctgacgcaaagccgcttgcgcgagcgcctggcgggttcggactccgtgatcttactggatgacgagtccttctatcacgaggacggcacaaatctaaatccgggcaccgaagcgacggatctggcctgcgtcatctatacgtcaggcacgacgggcaagccgaaaggcaaccttgtttcgcaccgcaacatcgtgcggatcgtgcgaaatacgaattatatcgacatcaccgaacgggatcatgtcctccagctttcgagctattcgttcgacggagcgattttcgatattttcggcgctttgaccaacggggcgcggctggtgctggttccccgcgagactttgctggaaatcgtccggctggcggatctcatccagcgtgagcgcatctcggtcatgctgattacgacggctttcttcaacgtccttgtagatgtgaacgtcgactgcctgcgggatgtccgggcgattttgttcggaggagagcgagtgtcggtcggacatgtgcgtaaagcgctcgcccatatcggaccgggcaggctcaaccacctgtacggcccgtcggaaagcacggtttataccacgtaccttccggtcgacttcgtcgatgagtcggcggttactgtacccatcggacggccgatcagtaatacgaaggtgtatatcgtcgacagccggaataagcttctgccgatcggcgtggccggggagctttgcgtcggcggagaaggcttggtacggggctacaataaccggccggagctgacggcggagaaatttgtggacaatccgtttgtgctgggagagcgcatgtaccggacgggggatttggcgaaatggctgccggacggcacgatcgaatacgtgggacggacggacgaccaagtgaaaatccgcggcttccgtattgagctgggcgagatcgaagctcagcttcagaaagtggagggaattcggaaagcgacggtattcgcgagggaagacgcctccggcgagaagcagctttgcgcttattatgaagcggaccgcgagcttccggcggccgagctgaagagcgtgctttcccaggaactgccggcctatatgattccggcgtacctgatccagttggagcagctcccgctgacgacgaacggcaaggtcgaccgccgatcactcccggcgccggaggagagcttgcagccgggcgaagaacgtactccgcctcggactccgctggaagccagcttggcgggaatttggaaaagcgtgctcggactggagcacatcggggttcatgacaacttcttcgacctgggcggccattccctgcgggcgacgacactggtgagcaaggtgcatcaggagctgaacgtcgagctgcctctgcgcgacgtattccgctactcgacgatcgaagagatggctctcgccatctcccggatcggagagcagtcgttctcgtcgattccgctggcgggcgcaagagcatattatccgctttcctcagctcagaagcggctgtttatcctgaatcagctggaaggggccgatcagagctacaacatgccgggcgtgctgctgctggaaggatcgattgaccggagcctgctggagaaggctttccgcggactgatcgcacggcacgaaacgctgcgaaccggctttgagatcgtacaaggcgaagctgtacagcgcatttacgagagcgtcgactttgccgtcgggtaccgtcatgtgagcgaggaagaagcgcccgaagtcgtgcaggccttcatccggcctttcgacttggcgaagcctccgctgctgcgggcggagctcgtagagctggcagccgaacgttatttgctgatgttcgacatgcaccatatcgtctccgacggggtttcgatggacgtgttagtcgaggaactcgttcgtctgtacggcggcgagtcattagagcctttgcgcattcaatacaaggactatgcggtatggcagcagtcggacgagcaaaaagtgcagttgaaacgcgaggaagcttactggctggaccgttaccggggcgagctgccggttctggaaatgccgacggactatccgcgtcctgccgtgcagagctttgagggacaaacgctgacgtccttcgtggacgaggcaacgaacgaaggcttgaagcagctggccgctcaaagaggaacgacgctgtatatggtgctgcttgcggcatataccgtgcttttgcataaatacacaggtcaggacgatttgatcgtcggaacgtcgattgcgggtagaacgcacggagaaacgcagcctttgatcggaatgttcgtcaatacgctggcgctccgcaattatccggcttcggagaagaccttcctgtcgtatctggaagaagtgaaagaaacgaccttaggcgcttacgagcatcagaattatccgttcgaagagctcgtcgataaagtgcaggtcagccgggatttgagccgcaacccgctgtttgacacgatgttctccctgcaaaacttggaggataaagagtttgagctggaagggctgaaattgtccccgtaccctagcgaatacggcacggccaagttcgacctgagtgtggatgttacggaagaaaacggcggcctggagtgcagctttgaattcgcaacggctctttataaagaaagcacgatccggcggctgtcgactcatttcggacatttgctcgtaacgatcgtaagccgtccggatgcgaagatcgccgagctgaacttgctgacggcagaggaaaaagaacaaattctcggcgcgttcaacccggcgcagccggaagcggctcctgcgtcggcgttccaccggctgttcgaggaacaggcggagcgcacgccggaagcggaggccgtcgtgtacgagaacgaccggcttacgtatgcggagctgaacgagcgggcgaaccgcttggcggctacgctgcgtgcaagcggcatcggccgggaggcgatcgtcggcattctcgccgagcgttcggtggacttgctggtggccgtgctggccgtctggaaagtgggcggggcgtatgtgccgctcgacccggattacccggcggagcgcgtgcggttcatgctcgaagacagcggagcgaaggtgctgctgacgcaaacgccgctgcgagagcgtgccgaagcatggctcggcgaagaggagctggcgctggcggcggtgctgtacctcgacgacgaagcgtcgtacagcgacgagcgggcgaatgcgtcggttgtctccggcaagctgacggatgctgtagatgacggcgatgagagccatcagaatgttggcaccgacagcttccatgaagcccgtccggaggatctggcgtacgtgatctatacgtcgggaacgacgggcaagccgaagggcgtgatgatcgagcaccgcagcctggtgaatacggcggcgggctaccggcgggaataccggttggatcagttcgcggtgcggctgctgcagctcgccagcttctcgttcgacgtgttcgtgggagatatcgcccggacgctgtacaacggaggcacgatggtgattgtgccgaaggacgaccggatcgatccgtctcgtctgcaccactggattgagcgggagcgggtcaccatcttcgaatcgacgccggcgctgatcgtgccgttcctagagtacgtgtacgagcagcaactggatatgagccggttggagctgttgatcacgagctcggacagctgcagcgtggcggattaccggaccttgcaggaacgcttcggctcgttgttccggatcatcaacgcatacggcgtgacggaagcggcgatcgactcaagcttctacgacgaggagctggcgaagctgccgcagacaggcaatgtgccgatcggcaaagcgtggctgaatgcgaaattctacatcgtggatgcgcatctgaacccggtgccggtcggggtgctgggcgagctggtcatcggcggagtcggagtggcgcgcgggtacttgaaccgtccggagctgacagaagagaagttcgtagacagcccgttcgccgagggcgagcggctgtaccgcacgggagacttggcgcggtggatggaagacggcaacgtggacttcatcggccggatcgacaaccaggcgaaaatccggggctaccggatcgagacgggcgagatcgagtcgcagctgctgcgggtggaaggcgtgcgcgaagcggtggtgctggttcgaagtgacgcgaacgggcagaaggcgctatgcgcgtattacacgccggataccggagcggaactggcggtgaacgatctgcgcggcgcgctggcgcaggagctgccgggctacatgatcccgtcgtacttcgtggagctggagcgcctgcctctgacgccgaacggaaagattgaccggaaggcgctgccagcgccggaaggggaagcgggaagcggaacggagtacgtcgcaccgcgcaatgagctggaaacgaagctggcggcgatttggcaggaggtgctggggcttgcgaaggagattggcgttcacgacaacttcttcgacatcggcggccactccctgcgggcgacgacgctggtcagcaagattcataaagagttgaacgtggatctgccgctgcgcgacgtgttccgccattccacgatcgagagcatggcggccgccatttcccggctggatgagcaaacattcgttgccattccggtggcggatgaccgagaggtgtacccgcaatcttttgctcaaaaacgtctctttatcctgaatcaactggaaggcgcggagcttagctacaacatgccggaagcgatgctgctggagggtgctttagaccgggcaaggttcgaagaagcgttccgtaagctcgtggcgcggcatgaaacactgcgcaccgggttcgaaatggtggatggcgaagcatcgcagcggatttaccaggacgtgaattttgccgtggagttctatcgagcggatgagcaagaggccgaagagacggttcgccgtttcgtccgtccgtttgacttggcgaagcctccgctgctgagggtaggccttgtcgagctggctccggaacgccatattctaatgtacgacatgcatcatattatttccgacggcgtctcgatggaaatctttgttgaagaattcgtccgcttgtacggcggcgagcaattggagcctctgcgcattcagtacaaagactacaccgtttggcagcattcgcaggagcagaaggaacggcttcagcgtcaggaggcgtactggctggacatgttccaaggcgagcttccggtgctggaaatgccgaccgactatccgcgtccggccgtgcagagctacgaaggccaaacgctggagtttttctttgacgcttcgaaaaccgacggcctgaagcagctggcctcggaaacgggcacgacgctgtttatggtgctgcttgcggcgtataacgtccttctgcataaatattcaggtcaggaagacgtgatcgtcggtacgccgattgccggaaggaatcatggagatgtgcagccgttgatcgggattttcttaaacacgctggctatccgcagttatccggcttcggagaagacattcctgtcatacctgaacgaagtcaaagaaacgaccctccacgccttcgagcatcaaaactatccgttcgaagaattggtggacaaggtgcaagtcacccgtgatttaagccgcaatccgctcttcgacacgctgtttacgatgcagaatacggagaacgaggaatttgagctggaagggcttcgcctgattccttatccgagcgcactggataccgcgaagtttgatatcagcttggatgtgggcgaggagaacggcggcttggattacagcttcgaatatgcgacggctctctacaaaagggagacgatcgaacggctggcaaaacattacgagcagctgctcgtaacgatcgtaagccgtccggatgcgaagatcgccgagctgaacttgctgacggcagaggaaaaagaacaaattctcggcgcgttcaacccggcgcagccggaagcggctcctgcggccgcgttccaccggctgttcgaggaacaggcggagcgcacgccggaagcggaggccgtcgtgtacgagaacgaccggctgacgtatgcggagctgaacgagcgggcgaaccgcttggcggctacgctgcgtgcaagcggcatcggccgggagacgatcgtcggcattctcgccgagcgttcggtggacttgctggtggccgtgctggccgtctggaaagcgggcggggcgtatgtgccgctcgacccggattacccggcggagcgcgtgcggttcatgctcgaagacagcggagcgaaggtgctgctgacgcaaacgccgctgcgagagcgtgccgaagcctggctcggcgaagaggagctggcactggcggcggtgctgtacctggacgacgaagcgtcgtacagcgaggagcgagcgaatgcgtcggttgtctccggcaagctgacggatgctgtggacgacggcgatgagagccatcagaatgttggcaccgacagcttccatgaagcccgtccggaggatctggcgtacgtgatctatacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgttcgacgtgttcgtgggagatatcgcccggacgctgtataacggaggcacgatggtgattgtgccgaaggacgaccggatcgatccgtctcgtctgcaccactggattgagcgggagcgggtcaccatcttcgaatcgacgccggcgctgatcgtgccgttcctggattacgtgcacgagcagcaactggacatgagctggatggagctgttgatcacgagctcggacagctgcagcgtggcggattaccggaccttgcaggaacgcttcggctcgttgttccggatcatcaacgcatacggcgtgacggaagcggcgatcgactcaagcttctacgacgagccgctgacgaagctaccgcagacaggcaatgtgccgatcggcaaagcgtggctgaatgcgaaattctacatcgtggatgcgcatctgaacccggtgccggtcggggtgctgggcgagctggtcatcggcggagtcggagtggcgcgcgggtacttgaaccgtccggagctgacggaagagaagttcgtagacagcccgttcgccgcgggcgaacggctgtaccgcacaggagacttggcgcggtggatggaggacggcaacgtggacttcatcggccggatcgacaaccagacgaaaatccgggggtaccggatcgagacgggcgagatcgagtcgcagctgctgcgggtggaaggcgtgcgcgaagcggtggtgctggttcgaagtgacgcgaacgggcagaaggcgctatgcgcgtattacacgccggataccggagcggagctggcggtgaacgatttgcgcagcgcgctggcgcaggagctgccgggctacatgatcccgtcgcacttcgtggagacggaacgcctgcctctgacgccgaacggaaagattgaccggaaggcgctgccagcgccggaaggggaagcgggaagcggaacggagtacgtcgcaccgcgcaatgagctggaaacgaagctggcggcgatttggcaggaggtgctggggcttgcgaaggagattggcgttcacgacaacttcttcgacatcggcggtcactccctgcgagcgacgacgctggcgggcaaggtatttaaggaattaaacgtcaacctgccgctgcgcgacgtattccgtcactcgacgattgcggcgatggccgaggcgatcgcccggatggaacggcgggagcatgaggccattcctcaagcggaggagagagagtactaccctctgtcctccgcgcagaaacggctgttcattcagcacacgctggatggagcggatcagctttacaacatgccggaactggtgcaggtggaaggcgagtttgatttagaccggttggaagccgccttgcggaaattgataacacggcatgaatcgctgcgcaccggttttgaaatcgtgaaggccgaagcggttcagcggatttacccgcaggtcgattttgctatcgagcatcatcaagcggataaagaggatgcggctcaaatcgagcagatcgtccgcagcttcgttcgtccgtttgatctcggcaagccgccgctgctgcgcgccggggtcatcgagctggagccgaacctgcatattctccttttcgacatgcaccatatggtgtccgacggcgtatcgatggcgattgtgatcgatgagttctcgagtttctacgccggggaagaactgccgccactgcgcattcaatacaaggattatgccgtttggcagcagtcgaaggcccaccgagagcggatcgggcggcaggaagcgtactggctgcaaaccttcgaaggcgagctgccgacggcggacctgccgatggactacgaacggtccgcggctcgcagctacgaaggcgcgcatctggagttcgacgtcgaagcttctctctctgcgcggctgcgcgaattggcggccgagcgtgaaagcacgctgttcatggtgctgcttgcggcttataccgtgctgctgtccaagtacagcgggcaggaggacttggtcgtgggcaccccggtggcgggaagaacgaacgccgatttggaaccggtcatcgggatgtttgtcaatacgctggcgatccgcaatcgtccgtcgggcgacaaaacgttcttgtcctacctggaagaagtgaaggaaacggctttgggtgctttcgagaaccaggattatccattcgaggagctcgtggagcgtttgaatgtgaagcgggagccgggccgcttcccgctgttcgatgccgttttcgacttgcaaaatatcgaagaacgagacgccgagctggaaggggtcagcctgaagacttacgagcttgaccatttggaagaagcgaagttcgatctgacgctgtttatgtatgaaaacaacggggcgctgagcgggggcttcttctacgccaccaagcttttcaaagaagcgatgatccgcaccttgaccgaggattacctgcgggtactgtctcaaattgcggaaaatccacaactcgagctaagccggattgaatgtcataaaccggcggcaggcgcaaagagtgccgtcgatacgatcgaattcgcgttctaa

SEQ ID NO: 5 - DNA, 3309 bp, Paenibacillus polymyxa F4
atgaaatctttgtttgaaaaggaagaacggtactggagcggcaagtttgacgccgatgacagcctgagcttccttccctacagtcaatcctccaaattatccgccgacggggaagctgcggccgagccgggcttgcttcaccgtactctgccgagcgaactctcggagagaatcatttgcctcgccaacggttcggatttggctttgtacatgattgttttggcaggagtaaaaagcctgctgttcaagtataccgggcgggaccaagtgctggtcggcatgccttcttatagcgcagaccccgacgggactccgccgccgcatgacatcttggtgatcaagacgtccgtaagccgccagactacgctgaaaacgctgctcgggggcatcaaagcctccatcggcgaggcgctggagcatcagcacctgccttttcggaaaatggtggagccgctccatctggactatacgggggacggcctcccggtcgtcaacaccgtcgtatccttcgccccgattcatccggaaccgctgggtaaccgggtggcggccgatacggtttttcgcttcgaccgccaaaaccactccatcgagctggaaataagctttgacgggcagcgttacgagcgggcatttgtggaacaggcggccgaccatcttgttaggctgctgtccgtgcttttatttcagccggatctggagcttggacaagccgatgtgctgtccccagacgagagggagacgctgctgaagcgatttaatgacaccgaaaccgagttcgagcgggggaaaacgatttacggcttgttcgaagaacaggcggagctttacccggacaacgtggccgccgtcatgaacgagcggcagctgacctaccgcgagctgaacgagcgatccaaccgccttgcgcggaagctgcgagagacgggagtagaagcggaccagctggtagcgattctggccgaacgctcgctcgatatggttgtcggcattctggcgattctcaaagcgggcggagcatacgtgcctgtcgatcccgactacccggaggagcgcatccgcttcatgatcgaggattcgggcgcgccgttattgctgattcaaaagcatctgcacgagaagaccgacttcgcaggaacgcgccttgaattggacgatttcgtgtggggcgacagaggggcggactccgccgatgtgcgggacgcttcgaacctggagccgatttccgggccgggcaacctggcttatgtcatctacacgtcgggaacgaccggcagaccgaaaggaacgctgatcgagcataagaacgtcgtgcgcctcctgttcaacgacaagaacctgttcgacttcgggccgtccgacacgtggacgctgttccactcgttctgcttcgatttctccgtctgggaaatgtacggagcgctgctgtacggaggcaagctggtcatcgtaccgccgctcacggcgaaaaatccggccgatttcctggcgctgctgggccgcgaacaggtcacgattttgaaccagacgccaacgtacttctaccagctgctgcgtaaggtcttggcggaccatccgtacgatctgcggattcgcaacgtcatcttcgggggcgaagcgctgagtccgctgctgctcaagggattcaagacgaagtacccggagacgaagctgatcaatatgtacggcattaccgagacgacggttcacgttacgtataaggaaataacgtgggtcgaaatggaggcggcgaagagcaatatcggcaagccgatcccgacgctgagcgtgtacgtccttgatgaaaaccgctcccctgtgccgatcggtgtagcgggcgaaatgtacgtggccggggaaggccttgcgagaggatacctgaaccgtccggatctgacggcggagaagttcgtcgattccccgtttgcggagggggagaaactgtaccgctcgggcgacttggcggcttggctgccggacggcaacatcgaatacctgggccggatcgatcatcaggtgaaaatccgtgggtaccggatcgagctggacgaaatcgagacgcagctgctgaagatcgccgccgtgcaagaagccaaggtgctcgaccgcgacgacgcgaacggccataagcagcttgtcgcttattacgtcgcggaaacgaggctggcggcgcatgaactcaaggaggagctcgccaagcagcttccggggtatatgattccttcgcacctcgtgcagctttcgcggatgccgctgaccccgaacgggaaaatcgaccgcaaagcgctgcccgcgccggaggaagccgcggccggaggagcggaatatgtcgcgccgagaacgctgctcgaaatgaagatcgcccgcgtctggcaggatacgcttggcgttccgcaggtcggcgtaaaggataacttttttgagttgggtggcaattcgttaagtctgatgaggctcgttcaagccgtttacgatgaaacggacatcgagataccgctgaaccgccaattccacaatctaacagttgaagccatggctttcggcgagggggatctgggcctggataaagggggagactccttcattaagctgaataaagcaggagatctgaacgtgttctgcttccctccgggcagcggcttcggcatcggttaccgagagctcgcaagcaggctcgacggccggttcgtgctctacggcattgattttatcgacgatgccgtcgattacgaggccatgctgaaccgttatgtggacgagatcgtccgcatccagccggaaggaccttacgtgctgctcggctactgcttcggaggcaacctgacgttcgaggtagccaaaacgatggagaaaagagggtattccgtaacggacgtgctcatgttggactcgtggattaaggacacgctgacgccttccgaaacgtcggagaaagagcttgaagaaacgcttgccgatttcgacgaagaagagaaggaattaatgagcaacccgctcgtgcgggagcgagttcatcggaaggtcaaagcgaccttggcgtacgaagcgcagcttattaattccggcacgatcccggccaggatttacgaactgattgcgaaggacagcgaagcgttccgcctggagcaccaattgccttcctggcggggggcaacgacgcaagcttacgccgattaccggctggagggcgcgcacgaggaattgctggaactcgcgcgcgtggaagaaacggccgtcgtcatccgggacatcttagagcaagtcaagcggcggatcgaagcggaggccggggtactgcatggaagctga

SEQ ID NO: 6 - DNA, 18846 bp, Paenibacillus polymyxa F4
gtgagagagaataccaacgagcaatatggattaacgcaagcccagcgccgaatatggttcatggaaattatgaatccgggaacgtccatcacgatgctttccgcgacctaccagattacgggcgagatcaacacacagcttctggagcaagcggcggcagagatcgtcaaaacctatgacgttttccgaatccgcattagcggggatttgcaaaatccaacgcagtggttcgaagaaccggagaatgtccaagctaggataagccgcctcgaaataggcacaaccgaacaattctatgcttgggtgaaagaagtaagcgaaaaaccggccagcgtgttcgacgaacacctctaccaatttacgattatccattttgcgaacggccaagtatggctcaatttgacggtaaatcatattatcgccgacggcttgtccgtcaatgctttgctgcatgcggtgatggaaaaatacctggaactgcgcaaaggcatctccagcagttaccaggccccttcctatctggattatatttctgcggagcgtgaatatgagcaatcgcagcgttatcaaaaaggcaaggaatactggctgacgaagtacaacactttgcctgaaacgaccggcattaaatcgtatccgccattctcgatcggcagcgaatccaataaactggccatcactttggacggttcccggtatgaacgcattctggccttcagcgaacaatatcaggtcagcttatatacgttatttctgtccgccatgtacgccttattgtacaagctgaccgacagcaccgatgttccggtcggcacggttttcgccaatcgcaccagcaagaaggaaaaagaaacgatcggcatgttcgtcagcaccgtggctacgcggatccgtctgaatccagacaggcacgtgctttccttgatccaaacggtttccaaggaaaatacggcggatctgcggtatcagaaatacccttataaccaattgatccaggatttacgcgaacaacacggccgcaacgatctttcggggctgttccgcacgtctctggaatatctgcctttgaaaatcgtggagtacgaagaaatcaaggtacgcctggaggctcacttcgctaggcacgagatggacgatttgctgctgcgcttcgaccatatgctgaatgaaggccatgtaattctccatgcttcctatcgtaccggcctgttcgagacggccgagattgatcggattatggaacagtatgtaaccgttctggaccagtttcttcagactcccgaactgccggtacgcgagatttctctgctgagcgatgaggagagacaccgcattctcaacgtttttaacccgccggtggcagggctgagcgagggagaagcgtttcatcggtatgttgaaaagtttgccctggaaattcctgatcatccggcagtcgtctacatggacaaacagctgacctacggcgaattgaacgaacgcgccgagcggctggcttctctccttcgcgaacagggcgtgggaagggagacgattacggggatctgggcggagcgttcggtggaactgctggtcggggtgctcgccgtttggaaagccggcggagcctatgtaccgctggaccccgattatccggcggagcggattgagtacatgctcagcgatagcgaagcaacggtgctgcttacgcagcgtcatctgttggagcgggccggagtttggttggccgatgaccggctgaagcttcaagctgtctatgccatggacgatgaacagatttataacggggatgccttagccgtggaatttgaatctgccggcagcgccccgcaagacttggcttatgtgatttacacctcgggtacgacgggacgcccgaaaggcgtcatgatcgagcacggtagtctcgtgaatacggcggatgcgtaccgtcgcgagtaccggttggatcagtttccggtgcggctgctgcagctggccagcttctcgtttgacgtgttcgtcggagacatcgcgcggacgctgtataacggaggcacgatggtgattgtgccgaaggatgaccggattgatccgaacctcttatacggctggattcgggaccaaaatattacggtattcgaatcgacgcctgcgctcatcctgccgttcatgcagcatatttatgaagaagggctggacgtcagctccatacagttgctgattaccagctcggatgcttgcagtgtcaccgattaccgattgctgctggaaagattcggcggacaattccgcatcattaacagctatggcgttaccgaagcggccattgacagcagcttttacggtgagccgctggataagctgccgccgtcgggtcatgtgccgatcggcaaagcttggctgaacgcccggttttacattgtcgatgccgcgttaaagccagttcctgtaggggttccgggcgagcttgtcataggcggcgccggggtggcgcgcgggtactggaaccgtctggacctaaccgccgagaagtttgtggacagcccgtttgtgccgggcgaacgtgtgtaccggacaggcgatttggcccgctggttggaagacggcaacgtcgacttcatcggccggatcgactatcaggtgaaaattcgcgggttccgtatcgaacttggcgaaattgaaacggccctgctgcgtttcccgggcgtcaagcaggctgtggtgaccgaccgcacggatgagcaggggcaaaagtatttgtgcggctacgtggcggcggatgcttccttgcagctgagcgatctgctgtcccaattgaagcaagagctgccggcccatatggtcccggcccggctggtgtctcttgataagcttccgctcacgccgaacggcaaaattgaccgtaaagcgctgcctgaaccgaccggagaggtagaaacaggcggtgagtatgtggctcctcgcacaacgctggaaacaagacttgctctcatttggcagcaggtgctgggtattgcgcgagttggagtccaagacgatttctttgacttgggtggtcattccttgcgggcctccacgctggtttccaagattcggaaagagctgcaagtcgaggttccgctgcgggaagttttccgctacaccacgatcgaacagctggcccaaagaatcggcggtttaaggcagcaggagacgtatgagattacaaaggcggctgaggccgagtactatccggtttcatccgagcaaaagcgtctgtacgtcctgcgccagcttgacggggccgagcgcagctacaatatgtcggcggcgcttcttctcgaaggcaagctggaccgcacgcgcgtcgagcacgcgttccgggcgctgattcagcgccatgagacgctgcgtaccgggatcgagcaggttcaaggcgagcttgtccagcgcatctatgacgaggtggagtttgctgtagattatttccaagcgagcgagtgggaagtggaccaagtggtggaagcatactatcacccgtttgatctgaccaagccgccacttctccgcatcggcctgatcgaagtcgacgaggatcgccacattctgctgttcgatatgcaccatatcgtctcggacggcatttcgacagcgctgctcttcgacgagttcagccgcctgtatcggggcgaggagctggccccgctgcgcattcaatacaaagattatgccgtttggcagcattccgaagcttacgggcagatgctccagccgcagaaggagtattggctgaaacagctgtcgggcgagctgccggtcttggagctgccgacggacttcccgcggcctgcggtgcaaagctttgacggccgaaccgtgaagttttatatcgagaaagatcggacggagaagctgaaagagctggcggcacggacagggacgaccctgtacatggtactgctgtcggcttacaccatccttatgcataaatattcgggtcaggaagatctgatcgtaggaacgccgattgccggaagaacgcaggaagaagtgcagccgatcgtagggatgtttatcaacacgctggccattcgcagccgtccggagcgttccaagccgtacctttcgtacctggaagaaatcaaggacatcacgctcggggctttcgaacaccaaaattatttgttcgaagacttggtagaaagtcttcacattccgcgcgcgaccggccggaatccgctctttgacacgttcttctccctacaaaatacggagaacgagcaaattgtcatcgaggggctggagcaatcgttttatccactggaaaaccaaacatccaagttcgagctgctcctggatatttcggagctggacggtcagctcgaatgccggttggagtacgctacggctttgtataaacaagagaccgcggagcggttcgccagacattatgacaagctgctcgaaaccatcgcagcagcgccggacggggatattgcctcgctggaaatgctcacggaggaggaaatccgcgagttggtgcgcggtttcaacgattcggaggcggactacccgcggcagcagacgattcacggcttgtttgaagagcaggcggagctttatccggacaacgtggccgccgtcatgaacgagcggcagctgacctaccgcgagctgaacgagcgatccaaccgccttgcgcggaagctgcgagagacgggagtagaagcggaccagctggtagcgattctggccgaacgctcgctcgatatggttgtcggcattctggcgattctcaaagcgggcggagcatacgtgcctgtcgatcccgactacccggaggagcgcatccgcttcatgatcgaggattcgggcgcgccgttattgctgattcaaaagcatctgcacgagaagaccgacttcgcaggaacgcgcctcgaattggacgatttcgttgggggcgacagaggggcgaactccgccgatgtgcgggacgcttcgaacctggagccgatttccgggccgggcaacctggcttatgtcatctacacgtcgggaacgactggcagaccgaaaggaacgctgatcgagcataagaacgtcgtgcgcctcctgttcaacgacaagaacctgttcgacttcgggccgtccgacacgtggacgctgttccactcgttctgcttcgatttctccgtctgggaaatgtacggagcgctgctgtacggaggcaagctggtcatcgtaccgccgctcacggcgaaaagtccagccgatttcctggcgctgctgggccgcgaacaggttaccattttgaaccagacaccaacgtacttctaccagctgctgcgtgaggtcttgacggatcatccatacgatttgcggattcgcaatgtgatctttgggggcgaagcgctgagtccgctgctgctcaagggcttcaagacgaagtacccggagacgaagctgatcaatatgtacggcattaccgagacgacggttcacgttacgtataaggaaataacgtgggtcgaaatggaggcggcgaagagcaatatcggcaagccgatcccgacgctgagcgtgtacgtccttgatgaaaaccgccgccctgtgccgatcggcgtagcgggcgaaatgtacgtggccggggaaggccttgcgagaggatacctgaaccgcccggatctgacggcggagaagttcgtcgattccccgtttgcggaaggggagaaactgtaccgctcgggcgacttggcggcttggctgccggacggcaacatcgaatacctgggccgaatcgatcaccaggtcaaaatccgcgggtaccggatcgagctggacgaaatcgagacgcagctgctaaacgtcgagggcgtggaagaagcggtggtgcttgcccgtcaggacggcgggggcgagaaggcgcttgtcgcctactttgtggcggaccggacactgacggtcagcgaaatgagaacctcgctggcccagggaatgccggggtacatgatcccgtcgtacttcttgcagcttgagcgcatgccgctgacgtccaacggtaaagtggaccgcaaagcgctgccggagccgcaaggcggcttgcaaacgggcgtcgaatacgtagcgccgcgtaaccggacggagtcccagcttgtgaagatctgggaggaagtgctgggttactccggcattggagtcctggacaatttcttcgagctcggaggccactccttgcgggcgacgaaccttgtcagcaagattcggaaggaaatgaacgtcgaacttccactgcgcgatgtgttccgctatacgacggtagagtcgatggccggggctattgccagcttggaagaaacacagcacagctcgattccgaaagcggaagagaaagcgtactatccggtttcctccgcgcaaaaaaggctgtacgtcctgcaccagctggatagctcggagctgaattacaacctcccaagcgccttgcaattggaaggggctttgaacgaggccaaagtggaaaaggcgctgactactttggtggcccggcacgatatgctgcgcaccggttttgaaatcgtgaatggggagccggttcagcgtattcatccgctcgtagctttcaaggtcgagaagcttcaagcaagcgaagatcaggttgcggccattcttgaaggcttcattcagccttttgacttgacccagccgcctttgctgcgcgccctactgatcgaactggagaaagagaaattcctgctcgcgctggatattcatcatattggttccgacggcctttccatggacgtgctgctgcgcgaattcgtgcggctttacaatggggaagaattgccggagctgcggattcaatacaaggattacgccgtttggcagcaatccgaggaacagcgccagcgcatcaaacggcaggaggaatactggcgcggggtattcagctccgagcttccggttcttgagctgcctctcgacttctcccgcccggccgtccagcagtttgacggtcaaacgctcacgtttacgctggatgcggagaaaagcgaagctctcaaacggcttgccggcgattcgggggcgacgctgtacatgcttctgctggctgcttactccgtattgcttcataaatacgcgggacaggaagatatagtggtcggcactccgattgccgcccgttctcacgccgacctgcagccgattatcggcatgttcgtcaatacgctggcccttcgcttgggtccggtggcggagcggacgttcctggattacttgcaggaagtgaaggaaacgacgcttggagcctacgagcaccaggactatccgttcgaggagctggtggaagctcttcaggtgagccgggatttaagccggaatcctctgtttgacaccatgttttctttgcaaaagcacgaaagcttggatttaaccctggaaggcttgcaatggtcgctgttcgacatcgaggaaaagacggcaaagtttgatcttagctttgatatcgtggaagccgataacgagctgatttgcaagatcgagtacgctacctcgttgtttagacaggaaacgatggtacggctggcgggtcattacgagcagcttttggcgtcgatcctggctcagccgggtgcgcggatttcggatttggatatcttgacggacagcgaaaagcatgatttgctggtcgggtttgacgtgtcgtcttcggctcttgcgaagcaacccgccgcagagggtacaggtttggaagcggatgagtcgtggagagagagaacgttccacgagctgttcgaggagcaggcggagcgcactccgggagcgctggcggttgtctacgaagacagcaagctgacgtatgcggagctgaacgccaaagcgaatcgtctggcgtatgcactgcgggcgcgcggggtgaagccggagcaggtggtcggcattctggccggccgttcggcggagctgttgatcggggtgctcgccgtatggaaagcgggcggcgcttatgtgccgctcgacccggactatccggcggagcggatcgagtatatgctcgcggacagcggggcgtcggtgctgctcacgcagacccgcctgctggagcaggcggaagcttggcgcagcgacggagctctagtgctgcaaacggtgcttgcgcttgacgacgccgcgacgtacagcctcggagcggcggaagcggctgtgggcgaagcaggcgcagaggcggaggctttggcgcaagcggctgctgccgaatcgtccgccacggcagaagccgagaagaacgtactagcggcggatctcgcatcgaatccggcgaatgtgaacaagccgcgcgatttggcttacgtcatctacacctccggtacgacgggccgtccgaagggcgtggcggtggaaaaccgcagcctggtgaacacggcggcgggctaccggcgggaataccggttggatcagttcccggtgcggctgctgcagctcgcaagcttctcgttcgacgtgttcgtgggagatatcgcgcggacgctgtacaacggcggcaccatggtcatcgtgccgaaggacgaccggattgatccaacccgcctctacggctggattcgcgactacgccgtgacggtgttcgaatcgactccggcgctgatcgtgccgttcatggagcatgtgcatgccgagggtctggacctcagctcgatgcagctgctgatcacaagctcggatgcgtgcagcgtagcggattaccgcaccttgcasgagcgcttcggctcgcagttccgtattattaacagctacggcgtaacggaagcggcgattgactccagcttctatgacgagccgctggagaagctgccgaagacgggcagcgtgccgatcgggaaagcgtggctgaacgccaagttttacatcgtggatgcgaatctgaagccggtgccgatcggggtgttgggcgagctggttatcggcggagcgggtgtggcccgaggttacttgaaccgcccggatttgacggcggagaaattcgtagacagcccgttcgccgctggggagcggctgtaccggacgggcgacctggcgcgctggatgccggacggcaacgtggacttcatcggccggatcgacaaccaggtgaaaattcgcggctatcggatcgagcttggtgaaattgaagcggccatgaaaaattttgccggcgtgcgtcaagcgcttgtcatcgaccggacggacgagcgggggcagaaatatttgtgcgggtatgtcgtagcggattccagcttcgatctggaagggcttgtggcccatctggacgccgcgctgccttcccatatggtgccttcgcgcatcatgcgcctggatcaaatgccgcttacgccgaacgggaagatcgaccgtaaagcgctgcctgtaccggaaggaagcattcgtgccgaggctgcatacacgrcgcctcgtactcctgccgagcaagcacttgcgtcggtctggcagtcagtgctgggcgtggatcaggtcggcacgatggacaatttctttgcgctcggcggcgattcgatcaaggccttgcaggtatcgtcccgtcttttgcaaacggggtacaagctggtcatgaaagatttgttccattacccgacgatttccgcccttagtttgcagctgcaaacggcggagagaacggcaagccaggccgaagtgacgggagaggtcatcttgaccccgattcagcgttggttctttgaacaaaatccggccgacgtgcatcacagcaaccaggcgttcatgcagttctccaagcaaggctttgacgaagaagctttacgccaagcggtgcgtcagcttgtcgtgcatcacgatgctctccgtacggtttaccgccaaactgagaacggctataccgcctggaatcgcggcgccggggagaacgaagcgctgttcgatctggaagttgtcgatttcaagggagtcggcgacgtgaaagaagcggtagaggctaaggcgaatgacattcaagcgagcatcgatctggaaaacggtccgctggtgaagctcggcttgttccgctgcgacgacggcgaccacctgctcatcgcgatccatcacttggtcgtagacggcgtatcctggcggattctgcttgaggattttgctgcctgctatgagcaggcgctgcaagggcagccgatccgtctgccgctcaaaacggattcattccaaacgtgggcgaaacagctcgctgattatgcgaacggtccggcgatggaaagcgagagagagtattggcagcatatcgagcaattgacctatgagccgcttccgaaagattttgaacaaggcagatccaagctgaaggacagcgggctcgtgaccgttcgctggacggcggaggaaaccgaacagctgctgaagcaggcacactgtgcttaccatacggaaatgaacgatttgctgcttgccgcgcttggcctcgcggtacaagcttggagcggccgggaacgcgtgctggtgaatctcgaaggccacggccgggaagatattttgccgaatgtggacattacgcgcacggtaggctggtttacaagccaattccctgtcgttctggagccgggtcacgcccaggcgctcggtcatcaggtaaaacaggttaaagaaagcttgcgccgcattccgaacaaaggaatcggctacggcatcctgcgttatttgtcggcgccgcgtgacggcgagcgcttcgctttggagccggagatcagctttaactatttgggtcagttcgaccaggattacgaaagcagcggctcgaggccgtctccgttcagcccgggctccgattcaagcccggatgcagtgatggattatgtcctcgatatcaacggtatggtgtcggaaggagtgcaggaactcacgatccgttatggggaaacccagtataaacgggaaacggtagagcgcctgggcaccctgcttcattcgagcttgcgtgaagtcatcagccattgcgtatcgaaagagcggccggagcttacgcctagcgacgtactgcttcaagatgtgacgttggaggaactggagcggctggccgaacatacggcggcgctcggcgaactggagaatgtatacaccctgactccgctgcaaaaagggatgttgttccacagcctgctggatgccgattcggaagcttacttcgaacaggtgaccttcgatctgtacggaagcctgaatgtcgaagccttcacccaaggattggatacgctggtgcagcggaatgaggcgctgcgtaccaactttattaccggctggagagacgagccgattcaagtggtattccgcgagcggaagtgtgaagtgtacttcgaagatattcgctcggtaagcgatgaagacccggagaagacgatagccgatttcgtcagcgcggataaagcgaataagttcgatttggcccgaggctctcttatgcgcgtgacagttttgcgcacgggcgacgagtcctaccatgtgatctggagtcaccatcacattttgatggacggctggtgcatgtccttcatgatcaaggaagtgttcgacacctacttcgctttccaggagaagcggacgctggagcttcctccggttacctcgtactcccggtatatcgaatggctggaagctcaagatgccgcgaaagcttcgcgttactggtccgagtatttggcgggttacgatcagcagaccaagctgccccaggagaaaacgcagctgaagcagggcgcttttgaagcggctgaaatcgatgtggaactcagcaaggaactgaccgggcaaatcgagcgggtggcgcgccagcagcaggtgacgctcaatacgttcatgcagaccgtatggggactggttctgcaggtatacaacaacagcgaggatgtcgtattcggctccgtcgtatccgggcgtccggcggaaattccgggcatcgaaagcatgatcggcctgtttattaacacgatcccggtccgtattcaaggcaaagccgaggagacggtagccgatatcttgagaaaaacccaggatcaagcgctggcatcgggagcttacgaaacgttcccgctgttcgaaattcagtcgctgagcgagcacaagcgcgacttgatcaaccatatcatggtctttgaaaattatccgatggaagaacagattgagcaggtcgtcggcggagacaaagaagcgctgaaaatcgctaatatccagtcgccggagcaaacgaactacgacctggacattaccgtcattccggaagagcatattttgctgcggtttacgtacaatgcgctgacgttcagagaggaagacatcaggctgatccacggtcattttgcccgggtactggagaaggttgcggctaacccgagcatccgcgtgaatcagttggagcttttgacggcggcggaaaaagagcaaattcttggcgcgtttaacccggcgcagccggaagcggctccggcggccgcgttccaccggctgttcgaggaacaggcggagcgcacgccggaagcggcagctgtcgtgtacgagaatgaccggctgacgtatgaggagctgaacgagcgggcgaatcgcttggcggccacgctgcgcgcaagcggcatcggccgggagacgatcgtcggcattctcgccgagcgttcggtggacttgctggtggccgtgctggccgtctggaaagcgggcggggcgtatgtgccgctcgacccggattatccggcggagcgggtgcggttcatgctcgaagacagcggagcgaaggtgctgctgacgcaaacgccgctgcgagagcgcgccgaagcctggctcggcgaagaggagctggcgctggcggcggtgctgtacctcgacgacgaaacttcgtacagcgaggagcggacgaatgccgacagcttccatgaagcccgtccagaggacctggcgtacgtgatctacacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgttcgacgtgttcgtgggagatatcgcgcggacgctgtacaacggaggtacgatggtgattgtgccgaaggacgaccggatcgatccgtctcgtctgcaccactggatggagcgggagcgggtcaccatcttcgaatcgacgccggcgctgatcgtgccgttcctggagtacgtgcacgatcagcggctggatatgagctggatggagctgttgatcacgagctcggacagctgcagcgtggcggattaccggaccttgcaggaacgcttcggctcgttgttccggatcatcaacgcatacggcgtgacggaagcggcgatcgactcaagcttctatgacgaggagctggcgaagctgccgcagacaggcaatgtgccgatcggcaaagcgtggctgaatgcgaaattctacatcgtggacgcgcatctgaacccggtgccggtcggggtgctgggcgagctggttatcggcggagtcggggtagcgcgcgggtacttgaaccgtccggagctgacagaagagaagttcgtagacagcccgttcgccgcgggcgagcggctgtaccgcacgggagacttggcgcggtggatggaggacgggaacgtggacttcatcggccggatcgacaaccaggcgaaaatccgggggtaccggattgagacgggcgaagtcgaagcgaagctgctgagtgtaggtggcgtgaaggaagcggtcgtcgtcgtcagggaagatcaagaaggtcagaaagctttgtgcgcttattatacagcggaagaaggcttgacggcggcggacctgaagcgggcgattgccaacgagctgccggggtacatgatcccgtcgtacttcgtggagctggagcacctgcctctgacgccgaacgggaaaatcgaccggaaggcgctgccggcgccggaagggggagcaagcgcaggccgcgaatacgtggcgccgcgcaccgaacttgaggcgaagctggccgccatttggcaggatgtgcttgttcgggagaaggcggtaggcgtaacggacaacttcttcgacctcggcggacactccctgcgggcgacgacgcttgtcagcaaaatgcataaggagctaggcgttgaatttccgcttcgcgacgtattccgctactcgacggttgaggaaatggccgcggctatggagcggctggagatcggctcgttcacggctattccggctgcggaacctagcgagtattatccgctctcttccgctcagaaacgtctctatatcttgaaccagctggaaggagccgagctgagctacaacataccgggagctatgctgctcgaaggggagctcgaccggcagcggtttgaagaagcgttccgcgggctcgtagctcgtcatgaaacgctgcgtaccggctttgagatggtaaaaggcgaagcggttcagcggatttacgaagaagccgccttccaggtggaatatgtgcagatcagcgcggagcaggcggaagaaacggtgcgccaattcgttcgtccgtttgatctagcgaagccgccacttctgcgggtgggccttgccgaactggcgccggaccggcacattctaatgttcgatacgcatcatatcgtatctgacggcgtttcgattgacgtactgatcgaagagttcgtccgcttgtacagcggggagcagttggagccgctccgcattcagtacaaagattatgcggtatggcagcaatcggacgagcagaaagctcagcttgccaagcaggaagcctactggctcgacatgttccgcggagagctgccggttttggaattgccgatggactatccgcgcccggctatgcagagctacgagggccgcacgctgcaattgtttatgcatagcgagaaaagcgagggtctgaaacggcttgcagccgagaacggcgcaacgctttacatggttctgcttgctggttatacaatattattgcataaatatacagggcaagaagacgtggtggtcggtacgccgattgcgggaagaaatcacagcgacgttcagccgctgatcgggatgttcgtcaataccctggccatccgcagttatccggctgccggtaagacgttccttgactacttgaaggaaatcaaggagacgacgctgggcgcttttgaacatcagaattatccgtttgaggaactggtggataaggtgaacgtggctcgcgatttaagccgcaatccgctgttcgatacgatgtttgctttgcagaatacagagaatttggaaatccagcttcccggactccatttgtcgacgtatgccagcgaagaaattgtttctaaattcgatctcagcttggacgtcacggagatcgaggaaggcttggaatatctgtttgaatacgccactgctctttataaaaccgaaacggtggagaaattggccgctcactacttgcagctgcttgaatccattctccgcaacccgtcggcgactattgccgagctgggcattttgacaccggcggaaaaagagcaaattctcggcgcgtttaacccggcgcagccgggagcggctcctgcggctgcgttccaccggctgtttgaggaacaggcggagcgcacgccggaagaggcggccgtcgtgtacgagaacgaccggctgacgtatgcggagctgaacgagcgggcgaaccgcttggcggctacgctgcgcgcaagcggcatcggccgggagacgatcgtcggcattctcgccgagcgttcggtggacttgctggtggccgtgctggccgtctggaaagcgggcggggcgtatgtaccgctcgacccggattatccggcagaccgcgtgcggttcatgcttgaagacagtggagcgaaggtgctgctgacgcaaacgccgctgcgagagcgtgccgaagcctggctcgacgaagaggagctggcgctggcggcggtgctgtacctggacgacgaagcgtcgtacagcgaggagcgggcgaatgcgtcggttgtctccggcattgtctccggcattgtctccggcaagctgacggatgctgtggacgacggcgatgagagccatcagaatgttggcaccgacagcttccatgaagcccgtccggaggatctggcgtacgtgatctatacgtcgggaacgacgggcaagccgaagggcgtgatgatcgagcaccgcagcctggtgaacacggcggcgggctaccgtcgggaataccggttggatcagttcccagtgcgcctgctgcagctcgcaagcttctcgtttgacgtgttcgtgggagatatcgcccggacgctgtacaacggaggtacgatggtgatcgtgccgaaggacgaccggatcgatccgtctcgtctgcaccactggatggagcgggagcgggtcaccatcttcgaatcgacgccggcgctgatcgtgccgttcctggagtacgtgcacgagcagcaactggatatgagctggatggagctgttgatcacgagctcggacagctgcagcgtggcggattaccggaccttgcaggaacgcttcggctcgttgttccggatcatcaacgcatacggtgtgacggaagctgcgatcgactcaagcttctatgacgaggagctggcgaagctgccgcagacaggcaatgtgccgatcggcaaagcgtggctgaatgcgaaattctacatcgtggacgcgcatctgaacccggtgccggtcggagtgctgggcgagctggccatcggcggagtcggagtggcgcgcgggtacttgaaccgtccggagctgacggaagagaagttcgtagacagcccgttcgccgcgggcgagcggctgtaccgcacgggagacttggcgcggtggatggaggacgggaacgtggacttcatcggccggatcgacaaccaggcgaaaatccgggggtaccggattgagacgggcgaagtcgaagcgaagctgctgagtgtaggtggcgtgaaggaagcggtcgtcgtcgtcagggaagatcaagaaggtcagaaagctttgtgcgcttattatacagcggaagaaggcctgacggcggcggacctgaaacgggcgattgccagcgagctgccggggtacatgatcccgtcgtacttcgtcgagctggagcgcctgcctctgacgccgaacgggaaaatcgaccggaaggcgctgccggcgccggaagggggagcaagcgcaggccgcgaatacgtggcgccgcgcaccgaactggaggcgaaactggtcgccatctggcaggacgtgctcgggccggtcacgattggcgtgacggacaacttcttcgacctcggcgggcactccctgcgggcgacgacgctggtcagcaaggtgcacaaggagctgagcgtggacctgccgctgcgcgatgtgttccggcactcgaccatcgaagcgatggccgaagcgatcagccaattggagcggcaggaacacctctccattccggttctggataagagggattactatccgctttcctccgtgcaaaaacggctgtacatccagcagcagatggaaggcgccgagcttagctacaacatgtccggcatgacggttctcgtcgggcgcttggaacggaatcaattcgaggcggcgctcaaaggattgatagctcgtcacgaaattttgcgaaccggcttcgaaatggtcgacggcgaaccggtacaacggatttatccggacttgaagtttgccgtcgagtatacgaaagcgacggaaagtgaaacgaagagcatcgtagacggctttgtgcgcgtctttgatttggagcggccgccgctgctgcgtgtgggcttagtcgaatgggaagcggaacggcatctgctcatgctggacattcatcatatcgtcacggatggcatgtcgatgggcatcttcgtcgaagagctgctgcgcctgtataacggcgagactatggaaccgcttcggattcaatacaaggaattcgccgcttggcagcagtccgaacctgtaaaagagcggctgaaacgtcaggaagcctactggctggacgtgctggaaggcgaactgccgacgcttgaactgcctacggactttgtcagacctgccgctcgcagctttgagggagatgtgctgcctttcagcatcgacaagcagatgaccgacagcttgcagcgcatcgccgatgagaacggtgccaccctttatatggtgttattggcggcctattcaatcctgctcagcaagtactcgggacaagaagacttcattgtaggcacgccggtttcgggccgcacacatgccgacctggagccgctcatcggaatgtttgtcaacactttggcgattcgccattatccgtccggggagaagacgttcctcgcttacttgaacgaagtcaaagaaacgatgctgggggcctacgaccaccaggattatccgttcgaggagcttgtgaaaaagctgcaggcgccgcgagatcaaggccgcaatcctgtattcgatgtcatgtttgctctggaaaccaaggaagataacgttcaaagcttcggggatatcaagatcgaatcttatccggaaactcatacggtttcccaatttgatcttaccttggtcatttcgttgctggatgagggaatgaacgggcagtttgaatatgccaccaagttgtttacacgcaatctgatcgacaatttcgctcaggacctgctcgtgatcatcacccaaatttgcgaacagccttcggtgctgttgaaggatatttccctgaacgggcaatccgaacaggagcaagatgtgctagagaccattgatattattttc

SEQ ID NO: 7 - DNA, 14991 bp, Paenibacillus polymyxa ATCC21830
atgtttgaaaaggcggagagcgaggctggagcgttgctgctgcatatgctccgccggattgcttttaccgatgaagagaggggaacgatccagatggcttttgaaaaagaaacgttgttttggaacgaaaaattcggtagcgacgattataccttgacgcggctgccttacagcaaagctccaagctccctgacgcccattatgacaaccgtcggcgggacgctttcggaggaagtggcgcagcgcgtccttcaaatgagcaagggcgctccgctggccacttttatgattttgctcgcaggtgttcagtccctcttgtataaatatacaggcgcttctgacattctggtcggcatgccggttgtacggaaaccgacggagacgcgccgatccgttaatcatacgatcattttgaaaaactcgctttcggcgggtgcgacttttaaaacgcttctgagcgagttgaggacttccttgccggaagcgattcagcatcaacatattccgttcttgaaaatgacggagaagctggatctgcaatatgcagacgggatacccgtcgtccatacgctagtatcccttaaggagctgcacctggacgaaatcggacaaaacgtggtcacggattgttcctttgaattcagcttaacgggcgggacgatacagctagcgttgtcatataacgagcacttatatgactccgagttcatgactcgggtcgttggccatctgaatcgactgttggccgtggggcttcacgagttggagctggagatcgtgcgggcggacatgctgtcggaggacgagaaatttcaattgttgcaaagctttaacgataccgagaaggactatccccgtgatcggacgattcatcaactcgtggaggagcaggcgaagcgggtgcccgaagcgacggcggttgtctttgagggtcggcggctttcgtacgcggagctgaacgaacgggcgaaccggctggcgcggacgctgcgatcggtcggcgtgctgcccaatcagctggtaggcttgatggccaggagatcactggagacggtcgttggcatactggcggttctgaaagctggcggtgcctacgtgccgatcgacccggaatacccggaagaacgcatccgctacattctggagaactcgaacgcgcagctgctgctgactcaaagggagctgctgcagcaggtgccgttcgaaggaaccgtgttggcgctggatgacgaacagacctacagcgacgatggctcgaacttggagccggccagcggtccgaatgatcttgcttatgtcatctatacgtcaggtacgacgggcaaacccaaaggggtcatgctggagcatcgcggtttggtcagcttgaagctgatgttcgcggataggctaggcatcacggagcatgaccggatcgttcaattcgccagcctgtcgttcgacgcgtcctgctgggaaatgttcaaagcgctctattttggcgcggctttgtatatcccgacggccgagacgattctcgacacccgcttgttcgagagttatatgaacgagcatgcgattacggcggcgattttgcctccaacgtacagcgcttatttgaacccggaccgccttcccagcttaacgaagctcgtaacgggaggctctgcggtatcggccgaattcgtgcagcaatggaaaccgaaggtccactatttcaatgcttacggccctaccgaagcttcgattgttacgacgctttgggatgcggatgaggagcagtcggagcgcagagtcattccgatcgggcgcccgctggccaatcaccggatttttattttggatgcccacctgcagcttgtgcctccgggagtggacggcgagctgtgcgtggccggcgtggggcttgcgagaggttacctgaaccatccggagctgacggcagagaagttcgtggaacatccgtttgcgccgggagaacgcctttaccggacgggagatctcgcccgctggctgccggacggaaatattgagtacttgggccggatcgatcatcaggtgaaaatccgtggattccggatcgagatcggcgagattgaagagcaacttctgaagatcgactccgtgcaggagacgatcgtaatcgcgcgggaaggcaaaagtggacaagaactgtgcgcttacctggtcgcgggccacccgcttacgctcggcgagttgagaagcgcgctggcgcaaaaattgccgaattacatgattccggcgcattttgttcagcttccgcggatgccgctcacgccgaacgacaaaatcgaccgcaaggctttgcccgtcccggaaggaaacgcactgaccggcggcgcgtacgtagctccccgcaatgaagccgagcggacgcttgccgatgtgtggcaggcggtattgaacgccgatcgcgttggggtaacggatcatttcttcgagctgggcggagactcgatcaagtccattcaagtatcttcgcggcttcatcaagccgggtacaagctggaaatccgggatttgttcaaatatccgactatctcacagctcagtctgcatgtgaaaccgatcggacgtaccatcgatcaaggcgaaataacgggtgaaacggcgctgacgccgattcagcattggtttttcgagagctcctttgcggacccgcatcatttcaaccagtcggtgatactgtaccggaaggaacgcttcgacgaagagacggtgcgtcaggtgctgcaaaagctggccgagcatcatgatgccttgcggatggtgttccgcaaaacggaacaagggtttagcgcgcggaaccgcgcgattcaagaaggcgggctgttcacgctggacgtgttcgacttcaaggatgcaaagaataccgcgcaggctgtggaagcgaaggcaacggacattcaagcgggcatcgatctggagaacgggcccctcgtgaaggcaggactgttccgatgcgcggacggcgatcatttgctgctcgcggttcatcatgccgtggtggacggcgtgtcttggcgtattttgatggaggatttcgccctgggttacgagcaggccggcaaaagtgaggaaattcgtttcccggcgaaaacggatgcgtaccgcacttggtccgagcagttggccgcttacgtgcaaagcccggagatggcgaaggaacgggcctattggcaggccgtggaacaaattgcggttccggccgtgccgaaggatctggaggcggacgttacgacgcagcaggacagcgaatcgctgttcgtctgtttgactcccgaagaaacggaactgctgctgaagcgggttcaccgggcctacaacaccgaaatgaacgatattttggtaacggcgctcggcatagccattcgcaagtggacgggacacgaacgggtgcggatcaatctcgaaggacacggacgcgaatcgatcggaacggatatcgacatcacgcgcacagtcggctggtttacgaccaagtttccggtcgtcctggagccggaaaccgaccgggatttggcctatcagattaaacaggtcaaggaaagcttgcgccgcattccgaacaaagggcttgggtacggcgtatgccgctatctctccaaatcggaggatggctttgtttggggtgcagagccggaaattaattttaactacctcggccagttcgacgatgatgtcaaccaggacgagatcggcatatcttcttattccagcggcagcccggccagcgaccggcaggcccgcagctttgtgctggatatcaacggcatggtgctggacggcgctttatcgctcgatctcagctacagccggaagcagtatcgcaaggaaacgatagaagccttcgctcagcggcttgagcaaagtctccgagagctcattacccactgcgcaggcaaagaaaacaccgaattgacgccgagcgacgtgcaatttaaaggcttgaccatcgcggaattggagcaaatcgcccagcgctcgggccatctcggggaaatcgaaaatatttactcgcttacgccgatgcagaagggcatgtggttccacagcgcgcttgaccggcagacggccgcttacttcgagcaaacgcggtttacgatgcggggagcactcgacgtccagcttttcgagaggagctggatggagcttgcgaaacgtcatctggtgctgcgggcaaattttgtgaaaggaccggcgggcgagccgctgcaaatcatataccgcgacaagccggtcggctttgaatatgaagagctgctccatttgcaggcggacgagaaacaaacgtacttggataaaaaggccgaggatgacaagcttcgcggcttcgacctggaacatgacgcgctcgttcgggttacgatcctgcgcaccgaagagcaaagctatcatgtgctgtggagtttccagcatattttgatggacggctggtgcctgccgcagctgacgcaggagctgtttgagacgtattcggccttggcatccggcaagcagccagcgggagataagggatcggattatggcgcttatatcgaatggttggagaaacaggacgatcaggcggcatccggctattggacggcattcctggcaggttatgaagggcaaaccgtactcccaggacaaaaggaaccggcgccaaacggcagatttacggctgatcacgtcaccgccgagctcggcaaggacttgagcgagcgaatggaccgggtggcgaaacagcgcctggttacggtcaatacgctgctgcaagccgcttggggcgtgatgctgcaaaaatataacgggacaaacgatgccgtattcggcagcgtcgtagccggaagaccggcggaaatcccgggcatcgagtccatgatcgggctgttcatcaatacggtgccggtccgcgtcacgagcgaagcggacaccgtgttcgccgacctgatggcgaagctccaagagcgggcgctggagtctgggcgttatgattactatccgctgtatgaaattcaagcccacagcgtgcaaaagcagaacctgatcaaccatatcatcgctttcgagaactatccggtggacgagcagatggagcaggcgggcgaccagcagcacggcgacctgacgatcgctgacgttcagatggaggagcagacgaactataacttcaacgtgaccgtggtgccgggagacgagatcgaaattcggttcgactttaacgcagaggtgttcgataaagacagcatcgagcggctcaaggggcatctcgtccatctgctggagcaggtgacggataacccggaaattacagtaggcgagctggaacttgtgacggaggcggaaaaggccgaccttctcggacgttttaacgacactaccacggaatttccgcgcgggaagacgctcattcaattgttcgaagagcaggcggagcgcatcccggatgcggctgccatctccttgaatgagcaagagctgacctaccgcgagctgaacgaacgcgtcaatcgccttgcccgtaccttgcgtagccacgggatatccaaaggccgtctggtcgccattatggctgagcgttccatcgaaatggtggtgggtatgctggcggcacacaaagccggagcggcttacgtaccgattgacccggaatatcccgaggagcgtatccgtttcttgatcgaggattcgggagcgcaggtcatgctgacgcaaagccgcttgcgcgagcgcctggcgggttcggactccgtgatcttactggatgacgagtccttctatcacgaggacggcacaaatcttaatccgggcaccgaagcgacagatctggcctgcgtcatctatacgtcaggtacgacgggcaagccgaaaggcaaccttgtttcgcaccgcaacatcgtgcggatcgtgcgaaatacgaattatatcgacatcaccgagcgggatcatgtcctccagctttcaagctattcgttcgacggagcgattttcgatgttttcggcgctttgaccaatggggcgcggctggtgctggttccccgcgagactttgctggaaatcggccggctggcggatctcatccagcacgagcgcatctcggtcatgctgattacgacggcttacttcaacgtccttgtagatgtgaacgtcgactgcctgcgggatgtccgggcgattttgtttggaggagagcgcgtgtcggtcggccatgtgcgtcgagcgctcgcccatatcggaccgggcaggcttaaccacctgtacggcccgtcggaaagcacggtttataccacgtatcttccggtcgactttgtcgatgagtcggcggttaccgtacccatcggacggccgatcagcaatacaacggtgtatatcgtcgacagccggaataagcttctgccgatcggcgtggctggagagctttgcgtcggcggagaaggcttggtacggggctacaacaaccggccggagctgacggcggagaaatttgtcgacaatccgtttgtgccgggagagcgcatgtaccgaacgggggatttggccaaatggctgccggacggcacgatcgaatacgtgggacggacggacgaccaagtgaaaatccgcggcttccgcattgaactgggcgagatcgaagctcagcttcagaaagtggagggaattcggaaaacgacggtattcgcgagggaaaacgcctccggcgagaagcagctttgcgcctattatgaagcggaccgcgagctttcagcggccgagttgaagaacgtgatttcccaggaactgccggcctacatgatcccggcgtacctgatccagttggagcggctcccgctgacggcgaacggcaaggtcgaccgccgatcccttccgacgccggaggagagcttgcagccgggcgaaggacgtactccgcctcgtactccgctggaagccagcttggccggaatttggaaaagcgtactcgcattggagcacatcggcgttcatgacaacttcttcgacctgggcggccattccctgcgggcgacgacactggtgagcaaggtgcatcaggagctgaacgtcgagctgcctctgcgcgacgtattccgctactcgacgatcgaagagatggctctcgccatcacccggatcggagagcagtcattctcgtcgattccgctggcaggcgtaagagaatattatccgctttcctcagctcagaagcggctgtttatcctgaatcagctagaagggtccgatcagagctacaacatgccgggcgtgctgctgctggaaggatcgattgaccggagcctgctggagaaggctttccgcggactgatcgtacggcacgaaacgctacgaaccggctttgagatcgtacaaggcgaagcagtacagcgcatttacgagagcgtcgactttgccgtcgagtaccgtcatgcgagcgaggaagaagcgcctgaagtcgtgcaggccttcatccgacctttcgacttggcgaagcctccgctgctgcgggtggagctcgtagagctcgcaaccgaacgttatttgctgatgttcgacatgcaccatatcgtctccgacggggtttcgatggacgtgttagtcgaggaactcgttcgtctgtacggtggcgagtcattagagcctttgcgcattcaatacaaggactatgcggtatggcagcagtcggacgagcaaaaagcgcagttgaaacgcgaggaagcttactggctggaccgttaccggggtgaactgccggttctggaaatgccgacggactatccgcgtcctgccgtgcagagctttgagggacaaacgctgacgtccttcgtggacgaggcaacgaatgaaggcttgaagcaactggccgctcaaagaggaacgacgctgtatatggtgctgcttgcggcatatacagtgcttttgcataaatacacaggtcaggacgatttgatcgtcggaacgtcgattgcgggcagaacgcacggagacacgcagcctttgatcggaatgttcgtcaatacgctggcgctccgcaattatccggcttcggagaagaccttcctgtcgtatctggaagaagtgaaagaaacgaccttgggtgcttacgagcatcagaattatccgttcgaagagcttgtcgataaagtgcaggtcagccgggatttgagccgcaatccgctgtttgacacgatgttctccctgcaaaacttggaggataaagagtttgagctggaagggctgaaattgtccccgtaccctagcgaatacggtacggccaagttcgacctgagtgtggatgttacggaagaaaacggcggcctggagtgcagctttgaattcgcaacggctctttataaagaaagcacgatccggcggttgtcgactcatttcggacatttgcttgcggagatcgtaagctgtccggatgcgaagattgccgagctgaacttgctgacggcagaggaaaaagaacaaattctcggcgcgtttaacccggcgcagccggaagtggctcctgcggccgcgttccaccggctgtttgaggaacaggcggagcgcacgccggaagcggcggccgtcgtgtacgagaacgaccggctgacgtatgcggagctgaacgagcgggcgaaccgcttggcggccacgctgcgcgcaagcggcatcggccgggagacgatcgtcggcattctcgccgagcgttcggtggacttgctggtggccgtgctggccgtctggaaagcgggcggggcgtatgtgccgctcgacccggattacccggcggagcgcgtgcggttcatgcttgaagacagcggagcgaaggtactgctgacgcaaacggcgctgcgagagcgtgccgaagcctggctcggcgaagaggaactggcgctggcggcggtgctgtacctggacgacgaagcgtcgtacagcgaggagcgggcgaatgcgccgattgtcttcggcatttccagcaagctgacggatgctgtggacgacggtgatgagagccctcagaatgttggcaccgacagcttccatgaagcccgtccggaggatctggcttacgtaatctacacgtcgggaacgacgggcaagccgaagggcgtgatgatcgagcaccgcagcctggtgaacacggcggcgggctaccggcaggaataccggttggatcagttcccagtgcggctgctgcagctcgcaagcttctcgtttgacgtgttcgtgggagatatcgcgcggacgctgtataacggaggcacgatggtgattgtgccgaaggacgaccggatcgatccgtctcgtctgcaccattggattgagcaggagcgggtcaccatcttcgaatcgacgccggcgctgatcgtgccgttcctggagtacgtgcacgaacatcggctggatatgagctggatggagctgttgatcacgagctcagacagctgcagcgtggcggattaccggaccttgcaggaacgcttcggctcgttgttccggatcgtcaacgcatacggcgtgacggaagcggcgatcgactccagcttctacgacgagccgctggcgaagctgccgcagacaggccatgtgccgatcggcaaagcgtggctgaatgcgaaattctacatcgtggatgcgcatctgaatccggtgccggtcggggtgctgggcgagctggtcatcggcggagtcggagtggcgcgcgggtacttgaaccgtccggagctgacggaagagaagttcgtagacagtccgttcgccgcgggcgagcggttgtaccgcacgggagacttggcgcggtggatggaagacggcaacgtggacttcatcggccggatcgacaaccaggcgaaaatccgggggtaccggattgagacgggcgagatcgagtcgcagctgctgcgggtgaaaggcgtgcgcgaagcggtggtactggttctaagtgacgcgaacgggcagaaggcgctgtgcgcgtattacacgccggataccggagcggagctggcagtgaacgatctgcgcagcacgctggcgcaggagttgccggggtacatgatcccgtcgtacttcgtggagctggagcacctgcctctgacgccgaacggaaagattgaccggaaggcgctgccggcgccggaaggggaagcgggaaacggaacggagtacgtcgcaccgcgcaatgagctggaaacaaagctggcggcgatttggcaggaggtactggggcttgcgaaggagattggcgttcacgacaacttcttcgacatcggcggccactccctgcgggcgacgacgctggtcagcaagattcataaagagttgaacgtggatctgccgctgcgcgacgtgttccgccattccaccatcgagagcatggcggccgccatttcccggctggatgagcagacattcgtttccataccggtggcggatgaccgagaggtgtacccgcaatcttttgctcaaaaacgtctctttatcctgaatcaactggaaggcgcggagcttagctacaacatgccggaagcgatgctgctggagggtgctttggaccgggcaaggttcgaagaagcgttccgtaagctcgtgacgcggcatgaaacgctgcgcaccgggttcgaaatggtggatggcgaagcatcgcagcggatttatcaggacgtgaatgttgccgtggagttctatcgagcggataagcaagaggccgaagagacggttcgtcgtttcgtccgtccgtttgacttggcgaagcctccgctgctgagggtaggccttgtcgagctggctccggaacgccatattctaatgtacgacatgcatcatattatttccgacggcgtctcgatggaaatctttgttgaagaattcgtccgcttgtacggcggcgagcaattggatcctctgcgcattcagtacaaagactacaccgtttggcagcattcgcaggagcagaaggaacggcttcagcgccaggaggcatactggctggacatgttccaaggcgagcttccggtgctggaaatgccgaccgactatccgcgtccggccgtgcagagctacgaaggccaaacgctggagtttttcttcgacgcttcgaaaaccgacggcctgaagcagctggcctcggaaacgggcacgacgctgtttatggtgctgcttgcggcgtataacgtccttttgcataaatattcaggtcaggaagacgtgatcgtcggtacaccgattgctggaaggaatcatggagatgtacagccgttgatcgggattttcttaaacacgctggctatccgcagttatccggcttcggagaagacattcctgtcatacctgaacgaagtcaaagaaacgaccctccacgccttcgagcatcaaaactatccgttcgaagaattggtggacaaggtgcaagtcacccgtgatttaagccgcaatccgctcttcgacacgctgtttacgatgcagaatacggagaacgaggaatttgagctggaagggcttcgcctgattccttatccgagcgcactggataccgcgaagtttgatatcagcttggatgtgggcgaggagaacggcggcttggattacagcttcgaatatgcgacggctctctacaaaagggagacgatcgaacggctggcgaaacattacgaacagctgctcgtaacgatcgtaagccgtccggatgcgaagatcgccgagctgaatttgctgacggcagaggaaaaagaacaaattctgggcgcgttcaacccggcgcagccggaagcgacttctgcggctgcgttccaccggctgttcgaagaacaagcggagcgcacgccggaaacggcagctgtcgtgtacgagaatgaccggctgacgtatgcagagctgaacgagcgggcgaaccgcttggcggccacgctgcgcacaagcggcatcggccgggagacgatcgtcggcattctcgccgagcgttcggtggacttgctggtggccgtgctggccgtctggaaagcgggcggggcgtatgtgccgctcgacccggattacccggctgagcgcgtgcggttcatgctcgaagacagcggagcgaaggtgctgctgacgcaaacggcgctgcgagagcgcgccgaagcctggctcggcgaagaggagctggcgctggcggcggtgctgtacctggacgacgaaacttcgtacagcgaggagcgggcgaatgcgccgattgtctccggcatggtctccggcaagctgacggatgctgtggacgacggcgatgagagccatcagaatgttggcaccgacagcttccatgaagcccgtccggaggatctggcatacgtgatctatacgtcgggaacgacgggcaagccgaagggcgtgatgatcgagcaccgcagcctggtgaacacggcggcgggctaccggcggaaataccggttggatcagttcccagtgcggctgctgcagctcgccagcttctcgtttgacgtgttcgtgggagatatcgcgcggacgctgtataacggaggcacgatggtgattgtgccgaaggacgaccggattgatccgtctcgtctgcaccattggattgagcaggagcgggtcaccatcttcgaatcgacgccggcgctgatcgtgccgttcctggagtacgtgcacgaacatcggctggatatgagctggatggagctgttgatcacgaactcagacagctgcagcgtggcggattaccggaccttgcaggaacgcttcggctcgttgttccggatcgtcaacgcatacggcgtgacagaagcggcgatcgactccagtttctacgacgaggaactggcgaagctgccacagacaggcaatgtgccgatcggcaaagcgtggctgaatgcgaaattctacatcgtggacgcgcatctgaacccggtgccggtcggggtgctgggcgaactggtcatcggcggaatcggagtggcgcgcgggtacttgaaccgtccggagctgacggaagagaagttcgtagacagcccgttcgccgcgggcgagcggctgtaccgcacgggagacttggcgcggtggatggaagacggcaacgtggacttcatcggccggatcgacaaccaggcgaaaatccgggggtaccggattgagacgggcgagatcgagtcgcagctgctgcgggtggaaggcgtgcgcgaagcggtggtgctggttcgaagtgatgcgaacgggcagaaggcgctatgcgcgtattacacgctggataccggagcggagctggcggtgaacgatttgcgcagcgcgctggcgcaggagctgccggggtacatgatcccatcgtacttcgtggagctggggcgcctgcctctgacgccgaacggaaagattgaccggaaggcgctgccggcgccggaaggggaagcgggaagcggaacggagtacgtcgcaccgcgcaatgagctggaaacgaagttggcggcgatttggcaggaggtgctggggcttgcgaaggagattggcgttcacgacaacttcttcgacatcggcggccactccctgcgggcgacgacgctggcgggcaaggtatttaaggaattaaacgtcaacctgccgctgcgcgacgtattccgtcactcgacgattgcggcgatggctgaggcgatcgcccggatggaacggcgggagcatgaggctattcctcaagcggaggagagagagtactaccctctgtcctccgcgcagaaacggctgttcattcagcatacgctggatggagcggatcagctttacaacatgccggagttggtgcaggtggaaggcgagtttgatttagaccggttggaagccgccttgcggaaattgataacacggcatgaatcgctgcgcaccggttttgaaatcgtgaagggcgaagcggttcagcgggtttacccgcaggtcgattttgctatcgagcatcatcaagcggataaagaggatgcggctcaaatcgagcagatcgtccgcagcttcattcgtccgtttgatctcggcaagccgccgctgctgcgcgccggggtcatcgagctggagccgaacctgcatattctccttttcgacatgcaccatatggtgtctgacggcgtatcgatggcgattgtgatcgatgagttctcaagtttctacgccggggaagaactgccgccactgcgcattcaatacaaggattatgccgtttggcagcagtcgaaggcccaccgagagcggatcgggcggcaggaagcgtactggctgcaaaccttcgaaggcgagctgccgacggcggacctgccgatcgactacgaacggtccgcggctcgcagctacgaaggcgcgcatctggagttcaacgtcgaagcttctctctctgcgcggctgcgcgaattggcggccgagcgtgaaagcacactgttcatggtgctgcttgcggcttataccgtgctgctgtccaagtacagcgggcaggaggacttgatcgtgggtaccccggtggcgggaagaacgaacgccgatttggaatcggtcatcgggatgtttgtcaatacgctggcgatccgcaatcgtccttcgggcgacaagacgttcttgtcctacctggaagaagtgaaggaaacggctttgggtgctttcgagaaccaggactatccattcgaggagctcgtggagcgtttgaatgtgaagcgggagccgggccgcttcccgctgttcgatgccgttttcgacttgcaaaatatcgaagaacgagacgccgagctggaaggggtcagcctgaagacttacgagcttgaccatttagaagaagcgaagttcgatctgacactgtttatgtatgaaaacaacggggcgctgagcgggggcttcttctacgccaccaagctgttcaaagaagcgatgatccgcaccttgaccgaggattacctgcgggtactgtctcaaattgcggaaaatccacaactcgagctaagccggattgaatgccataaaccggcggcaggcgcaaagagtgccgtcgatacgatcgaattcgcgttc

SEQ ID NO: 8 - DNA, 3306 bp, Paenibacillus polymyxa ATCC21830
atgaaatctttgtttgaaaaggaagaacggtactggagcggcaagtttgacgccgatgacagcctgagcttccttccctacagtcaatcctccaaattatcggccgacggggaagctgcggccgagccgggtttgcttcaccgtactctgccgagcgaaatctcggagagaatcatttgccttgccaacggttcggatttggctttgtacatgattgttttagcaggagtaaaaagcctgctgttcaaatataccgggcgggaccaagtgctggtcgggatgccctcttatagcgcagaccccgacgggactccgccgccgcatgacatcttggtgatcaagacgtccgtaagccgcgagactacgcttagaacgctgctcgggggcatcaaagcctccatcggcgaggcgctggagcatcagcacctgccttttcggaaaatggtggagccgctccatctggactatacgggggacggtctcccggtcgtcaacaccgtcgcatccttcgccccgattcatccggaaccgctgggtaaccgggtggcggccgatacggtttttcgcttcgaccgccaaaaccactccatcgagctggaaataagctttgacgggcagcggtacgagcgggcatttgtagaacaggcggccgaccatcttgttcagctgctgtccgtgcttttatttcagccggatctggagcttggacaagccgatgtgctgtccccagacgagagggagacgctgctgaagcgatttaatgacaccgaaaccgggttcgagcgggggaaaacgatttacggcttgttcgaagaacaggcggagctttacccggacaacgtggccgccgtcatgaacgagcggcagctgacctaccgcgagctgaacgagcgatccaaccgccttgcgcggaagctgcgggagacgggagtagaagcggaccagctggtagcgattctggccgaacgctcgctcgatatggtcgtcggcattctggcgattctcaaagcgggcggagcatacgtgcctgtcgatcccgactacccggaggagcgcatccgcttcatgatcgaggattcgggtgcgccgttattgctgattcaaaagcatctgcacgagaagaccgacttcgcaggaacgcgcctcgaattggacgatttcgtttggggtgacagaggggcggactccgaaggagcgctggacgcttcgaacctggagccgatttctgggccagtcaacctggcttatgtcatctacacgtcgggaacgaccggcagaccaaaaggaacgctgatcgagcataagaacgtcgtgcgcctcctgttcaacgacaagaacctattcgacttcgggccgtccgacacgtggacgctgttccactcgttctgcttcgatttctccgtctgggaaatgtacggagcgctgctgaacggaggcaagctggtcatcgtaccgccgctcacagcgaaaaatccggccgatttcctggcgctgctgggccgcgaacaggtcacgattttgaaccagacgccaacgtacttctaccagctgctgcgtaaggtcttggcggaccatccgtacgatttgcggattcgcaacgtcatcttcgggggcgaagcgctgagtccgctgctgctcaagggcttcaagacgaagtacccggagacgaagctgatcaatatgtacggcattaccgagacgacggttcacgttacgtataaggaaatcacgtgggtcgaaatggaggcggcgaagagcaatatcggcaagccgatccctacgctgagggtgtacgtccttgatgaaaaccgccggcctgtgccgatcggcgtagcgggcgaaatgtacgtggccggggcaggccttgcgagaggatacctgaaccgtccggatctgacggcggagaagttcgtcgattccccgtttgcggagggggagaaactgtaccgctcgggtgacttggcggcttggctgccggacggcaacatcgaatacctgggccggatcgatcatcaggtgaaaatccgcgggtaccggatcgagctggacgaaatcgagacgcagctgctgaagatcgccgccgttcaagaagccaaggtgctcgaccgcgacgacgcaaacggccaaaagcagcttgtcgcttactacgtcgcggaaacgaggctggcggtgcatgaactcaaggaggagctcgccaagcagcttccggggtatatgattccttcgcacctcgtgcagcttccgcggatgccgctgaccccgaacgggaaaatcgaccgcaaagcgctgcccgcgccggaggaagccgcggcccgaggagcggaatatgtcgcgccgagaacgctgctcgaaatgaagatcgcccgcgtctggcaggatacgcttggcgttccgcaggtcggcgtaaaggataacttttttgagttgggtggcaattcgttaagtctgatgaggctcgttcaagccgtttacgatgaaacgggcattgagataccgctaaaccgccaattccataatgtaacagttgaagccatggctttcggagagggggacctgggcctggataaagggggagactccttcattaagctgaataaagtaggaaatctgaatgtgttctgcttccctccgggcagcggcttcggcatcggttaccgagagctcgcaagcaggctcgacggtcggtccgtgctctacagcattgattttatcgacgatgccgtcgattacgaggccatgctgaaccgttatgtggacgagatcgtccgcatccagccggaaggaccttacgtgctgctcggctactgcttcggaggaaacctgacgttcgaggtagccaaaacgatggagaaaagagggtattccgtaacagacgtgcttatggtggactcgtggattaagcacacgctgacgccttccgaaacgtcggagaaagagcttgaagaaacgcttgccgatttcgacgaagaagagaaggaattaatgagcaacccgctcgtacgggagcgggttcatcggaaggtcaaagcgaccttggcgtacgaagcgcagctcattaattccggcacgatcccggcccggatttacgaactgattgcgaaggacagcgaagcgttccgcctggagcaccaattgccttcctggcggggggcaacgacgcaagcttacgccgattaccggctggagggcgcgcacgaggaattgctggaactcgcgcgcgtggacgaaacggccgtcgtcatccgggacatcttagagcaagtcaagcggcagattgaagcggaggccggtgtactgcatggaagc

SEQ ID NO: 9 - DNA, 17367 bp, Paenibacillus polymyxa ATCC21830
gtgagagaggataccaacgagcaatatggattaacgcaagcccagcgccgaatatggttcatggaaattatgaatccgggaacgtccatcacgatgctttccgcgacctaccagattacgggcgagatcaacacacagcttctgaagcaagcggcggcagagatcgtcaaaacctatgacgttttccgaatccgcattagcggggatttgcaaaatccaacgcagtggttcgaagagccggagaatgtccaagctaggataagccgcctcgaaataggcacaaccgaacaattctatgcttgggtgaaagaagtaagcgaaaaaccggccagcgtgttcgacgaacacctctaccaatttacgattatccattttgcgaacggccaagtatggctcaatttgacggtaaatcatattatcgccgacggcttgtccgtcaatgctttgctgcatgcggtgatggaaaagtacctggaactgcgcaaaggcatctccagcagttaccagcccccttcctatctagattatatttcctcggagcgtgaatatgagcaatcgcagcgttatcaaaaaggcaaggaatactggctgacaaagtacaacactttgcctgaaacgaccggcattaaatcgtatccgccattctcgatcggcagcgaatccaataaactgtccatcactttggacggttcccggtatgaacgcattctggccttctgcgaacaatatcaggtcagcttatatacgttatttctgtccgccatgtacgccttattgtacaaactgaccgacagcaccgatgttccggtcggcacggttttcgccaatcgcaccagcaagaaggaaaaagaaacgatcggcatgttcgtcagcaccgtggctacgcggatttgtctgaatccagacgggcacgtgctttccttgatccaaacggtttccaaggaaaatacggcggatctgcggtatcagaaatatccttataaccaattgatccaggatttacgcgaacaacacggccgcaacgatctttcggggctgttccgcacgtctctggaatatctgcctttgaaaatcgtggagtacgaagaaatcaaggtacgcttggaggctcactttgctaggcacgagatggacgatttgctgctgcgcttcgaccatatgctgaatgaaagccatgtaattctccatgcttcctatcgtaccggcctgttcgagaaggccgagattgatcggattatggaacagtacgtaaccgttctggaccagtttcttcagactcccgaactgccggtacgcgagatttctctgctgagcgatgatgagaaacaccgcattctcaacgtttttaacccgccggtggcagggctgagcgagggagaagcgtttcatcggtatgttgaaaagtttgcccgggaaattccggatcatccggcagtcgtctacatggacaaacagctgacctacagcgaattgaacgaacgcgccgagcggctggcttctctccttcgcgaacagggcgtgggaagggagacgattacgggtatctgggcggagcgttcggtggaactgctggtcggggtgctcgccgtttggaaagccggcggagcctatgtaccgctggaccccgattatccagcggagcggattgagtatatgctcagcgatagcgatgcatcggtgctgcttacgcagcgtcatctgttggagcgggccggaggttggttggccgatgaccggctgaagcttcaagctgtctatgccatggacgatgaacagatttataacggggatgccttagccgtggaatttgaatctgccgacagcgccccgcaagacttggcttatgtgatttacacctcgggtacgacgggacgcccgaaaggcgtcatgattgagcacggtagtctcgtgaatacggcggatgcgtaccgtcgcgagtaccggttggatcagtttccggtgcggctgctgcagctggccagcttctcgtttgacgtgtttgtcggagacatcgcgcggacgctatataacggaggcacgatggtgattgtgccgaaggatgaccggattgatccgaacctcttatacggctggattcgggaccaaaacattacggtattcgaatcgacgcctgcgctcatcctgccgttcatgcagcatatttatgaagaagggctggacgttagctccatgcagttgctgattaccagctcggatgcttgcagtgtcaccgattaccgattgctgcaggaaagattcggcggacaattccgcatcatcaacagctatggcgttaccgaagcggccattgacagcagcttttacggtgagccgctggataagttgccgccgtcgggtcatgtgccgatcggcaaagcttggctgaacgcccggttttacattgtcgatgctgcgttaaagccggttcctgtaggggttccgggcgagcttgtcatcggcggcgccggggtggcgcgcgggtactggaaccgtccggatttaaccgccgagaagtttgcggacagcccgtttgtgccgggcgaacgtctgtaccggacaggcgatttggcccgctggctagaagacggtaacgtcgacttcatcggccggatcgactatcaggtgaaaattcgcgggttccggatcgaactcggcgaaattgaaacggccctgctgcgtttcccgggcgtcaagcaggctgtggtgaccgaccgtacggatgagcaggggcaaaagtatttgtgcggctacgtggtagaggatgcttccgtgcagctgagcgatctgctgtcccaattgaagcaagagctgccggcccatatggtcccggcccggctggtgtctcttgataagcttccgctcacgccgaacggcaaaattgaccgtaaagcgctgcctgaaccgaccggagaggtagaagcaggccatgagtatgtggctcctcgcacaacgctggaaacaagacttgctctcatttggcagcaggtgctgggtattgcgcgagttggagtccaagacgatttctttgacttgggtggtcattccttgcgggcctccacgctggtttcaaagattcggaaagagctgcaagtcgaggttccgctgcgggaagttttccgctacaccacgatcgaacagctggcccaaagaatcggcggtttaaggcagcaggagacgtatgagattacaaaggcggctgaggccgagtactatccggtttcatccgagcaaaagcgtctgtacgtcctgcgccagcttgacggggccgagcgcagctacaatatgtcggcggcgcttcttctcgaaggcaagctggaccgcacgcgcgtcgagcacgcgttccgggcgctgattcagcgccatgagacgctgcgtaccgggattgagcaggttcaaggcgagcttgtccagcgcatctatgacgagttggattttgctgtagattatttccaagcgagcgagcgggaagtggagcaagtggtggaagcttactatcacccgtttgatctgactaagccgccacttctccgcatcggtctgatcgaagtcgccgaggatcgccacattctgctgttcgatatgcaccatatcgtctcggacggcatttcgacagcgctgctcttcgacgagttcagccgcctgtatcggggcgaggagctggccccgctgcgcattcaatacaaagattatgccgtttggcagcattccgaagcttacgggcagatgctccagccgcagaaggagtattggctagaacagctgtcgggcgagctaccggtcttggagctaccgacggacttcccgcgacctgcggtgcaaagctttgacggccgaaccgtgaagttttatatcgagaaagatcggacggagaagctgaaagaactagcggcacggacagggacgaccctgtacatggtgctgctgtcggcttacaccatccttatgcataaatattcgggtcaggaagatctgatcgtaggaacgccgattgccggaagaacgcaggaagaagtgcagccgatcgtagggatgtttatcaacacgctggccattcgcagccgtccggagcgttccaagccgtacctttcgtacctggaagaaatcaaggacatcacgctcggggctttcgaacaccaaaattatttgttcgaagacttggtagaaagtcttcacattccgcgcgcgaccggccgtaatccgctctttgacacgttcttctccctacaaaatacggagaacgagcaaattgtcatcgaggggctggagcaatcgttttatccactggaaaatcaaacatccaagttcgagctgctcctggatatttcggagctggacggtcagctcgaatgccggttggagtacgctacggctttgtataaacaagagaccgcggagcggttcgccagacattatgacaagctgctcgaaaccatcgcagcagcgccggacggggatattgcctcgctggaaatgctcacggaggaggaaatccgcgagctgatgcgcggtttcaacgattcagaggcggactacccgcggcagcagacgattcacggcttgttcgaagagcaggcggagctttacccggacaacgtggccgccgtcatgaacgagcggcagctgacctaccgcgagctgaacgagcgatccaaccgccttgcgcggaagctgcgggagacgggagtagaagcggaccagctggtagcgattctggccgaacgctcgctcgatatggtcgtcggcattctggcgattctcaaagcgggcggagcatacgtgcctgtcgatcccgactacccggaggagtgcatccgcttcatgatcgaggattcgggtgcgccgttattgctgattcaaaagcatctgcacgagaagaccgacttcgtaggaacgcgcctcgaattggacgatttcgtttggggcgacagaggggcggactccgaaggtgcgctggacgcttcgaacctggagccgatttccgggccgctcaacctggcttatgtcatctacacgtcgggaacgaccggcagaccaaaaggaacgctgatcgagcataagaacgtcgtgcgcctcctgttcaatgacaaaaacctgttcgacttcgggccgtccgacacgtggacgctgttccactcgttctgcttcgatttctccgtctgggaaatgtacggagcgctgctgtacggaggcaagctggtcatcgtaccgccgttcacggcgaaaaatccggccgatttcctggcgctgctgggccgcgaacaggttaccattttgaaccagacgccaacgtacttctaccagctgctgcgcgaggtcttgacggaccatccgtacgatttgcggattcgcaacgtcatcttcgggggcgaagcgctgagtccgctgctgctcaagggcttcaagacgaagtacccggagacgaagctgattaatatgtacggcattaccgagacgacggttcacgttacgtataaggaaatcacgtgggtcgaaatggaggcggcgaagagcaatatcggcaagccgatcccgacgctgagggtgtacgtccttgatgaaaaccgccggcctgtgccgatcggcgtagcgggcgaaatgtacgtggccggggaaggccttgcgagaggatacctgaaccgcccggatctgacggcggagaagttcgtcgattccccgtttgcggagggggagaaactgtaccgctcgggcgacttggcggcttggctgccggacggcaacatcgaatacctgggccggatcgatcaccaggtcaaaatccgcgggtaccggatcgagctggacgaaatcgagacgcagctgctgaacgtcgagggcgtggaagaagcggtggtgcttgcccgtcaggatggcgggggcgagaaggcgcttgtcgcctactttgtggcggatcggacactgacggtcagcgaaatgagaacctcgctggcccagggaatgccggggtacatgatcccgtcgtacttcgtgcagctggagcgcatgccgctgacggccaacggcaaagtagaccgcaaagcgctgccggagccgcaaggcagcttgcagacgggcgtcgaatatgtagcaccgcgtaaccggatggagtcccagcttgtgaagatctgggaggaagtgctgggctactccggcattggagtcctggacaatttcttcgagctcggaggccactccttgcgggcgacgaaccttgtcagcaagattcagaaggaaatgaacgtcgaacttccgctgcgcgatgtgttccgctatacgacggtagagtcgatggccggggctattgccagcttggaagaaacgcggcacaactcaattccgaaagcggaagagaaagcgtactatccggtttcctccgcgcaaaaaaggctgtacgtcctgcaccagctggatggctcggagctgaattacaacctcccaagtgccttgcagttggaaggggctttgaacgaagccaaagtggaaaaggcgctgactactttggtggcccggcatgatatgctgcgcaccggttttgaaattgtgaatggggagccggttcagcgtattcatccgatcgtagctttcaaggtcgaaaagcttcaagcaagcgaagatcaagttgcggccattcttgaaggcttcattcagccttttgacttgacccagccgcctttgctgcgcgccctgctgatcgaactggagaaagagaaattcctgctcgcgctggatattcatcatattggttccgacggcctttccatggacgtgctgctgcgcgaattcgtgcggctttacaatggggaagaattgccggagctgcggattcaatacaaggattacgccgtttggcagcaatccgaggagcagcgccagcgcatcaaacggcaggaggaatactggcgtggggtattcagctccgagcttccggttcttgagctgcctctcgacttctcccgcccggccgtccagcagtttgacggtcaaacgctcacgtttacgctggatgcggagaaaagcgaagctctcaaacggcttgccggcgattcgggggcaacgctgtacatgcttctgctggctgcgtactccgtattgcttcataaatacgcgggacaggaagatatagtggtcggcactccgattgccgcccgttctcacgccgacctgcagccgattatcggtatgttcgtcaatacgctggcccttcgcttgggtccggcggcggagcggacgttcctggattacttgcaggaagtgaaggaaacaacgcttggagcctacgagcaccaagactatccgttcgaggagctggtggaagctcttcaggtgagccgggatttaagccggaatcctctgtttgacaccatgttttctttgcaaaagcacgaaagcttggatttaaccctggaaggcttgcaatggtcgctgttcgacatcgaggaaaagacggcaaagtttgaccttagctttgatatcgtggaagccgataacgaactggtttgcaagatcgagtacgctacctcgttgtttagacaggaaacggtggtacggctggcaggtcattacgagcagcttttgacgtcgatcctggctcagccgggtgcgcggatttcggatttggatgtcttgacggacagcgaaaaacatgatttgctggtcgggtttgacgtgtcgtcttcggctcttgcgaagcaacccgccgcagagggtacaggtttggaagcggatgagtcgtggagagagagaacgttccacgagctgttcgaggagcaggcggagcgcactccggaagcgctggcggttgtctacgaagacagcaagttgacgtatgcggagctgaacgccaaagcgaatcgtctggcgtatgcactgcgggcgcgcggggtgaagccggagcaggtggtcggcattctggccgatcgttcggcggagctgttgatcggggtgctcgccgtatggaaagcgggcggcgcttatgtgccgctcgacccggactatccggcggagcggatcgagtatatgctcgcggacagcggggcgtcggtgctgcttacgcagacccgcctgctggagcaggcggaagcttggcgcagcgacggagctctagtgctgcaaacggtgcttgcgcttgacgacgtcgcgacgtacagcctcggagcggcggaagcggctgtgggtgtacaagctttgggcgaagcaggcgcagaggcggaggctttggcgcaagcggctgctgccgaaacgtccgccacggcagaagccgagaagaacgtactagcggcagatctcgcatcgaatccggcgaatgtgaacaagccgcgcgatttggcttacgtcatctacacctccggtacgacgggcaagccgaagggcgtgatgatcgagcaccgcagcctggtgaacacagcggcgggctaccgtcgggaataccggttggatcagttcccggtgcggctgctgcagctcgcaagcttctcgttcgacgtgttcgtgggagatatcgcgcggacgctgtacaacggaggcacgatggtaattgtgccgaaggacgaccggatcgatccgtctcgtttgcaccactggatggagcgggagcgggtcaccatcttcgaatcgacgccagcgctgatcgtgccgttcctagagtatgtgcacgagcagcggctcgatatgagcgggatggagctgttgatcacgagctcggacagctgcagcgtagcggattaccgcaccttgcaggagcgcttcggctcgcagttccgtattattaacagctacggcgtaacggaagcggcgattgactccagcttctatgacgagcctctggaaaagctgccgaagacgggcagcgtgccgatcgggaaagcgtggctgaacgccaagttctacatcgtggatgcgaatctgaagccggtgccgatcggggtgttgggcgagctggttatcggcggagtcggagtggcgcgcgggtacttgaaccgcccggatttgacggcggagaaattcgtagacagcccgttcgccactggggagcggctgtaccggacaggcgacctggcgcgctggatgtcggacggcaacgtggactttatcggccggatcgacaaccaggtgaaaatccgggggtaccggattgagacaggcgaagtcgaagcgaagctgctgagtgtaggtggcgtgaaggaagcggtcgtcgtcgtcagggaagatcaagaaggtcagaaagctttgtgcgcttattatacagcggaagaaggcttgacagcggcggatctgaagcgggcgattgccagcgagctgccggggtacatgatcccgtcgtacttcgtggagctggagcgcctgcctctgacgccgaacggaaagatcgaccggaaggcgctgccggcaccggaagggggggcaggaggccgcgaatacgtggcgccgcgcaccgaactggaggcgaagctggccgccatttggcaggatgtgcttgttcgggagaaggcggtaggcgtaacggacaacttcttcgacctcggcgggcactccctgcgggcgacgacgctggtcagcaaaatgcataaggagctaggcgttgaattcccgcttcgcgacgtattccgctactcaacggttgaggaaatggccgcggctatggagcggctggagatcggctcgttcacggctattccggctgcagaatctagcgagtattatccgctctcttctgctcagaaacgtctctatatcttgaaccagctggaaggagccgagctgagctacaacataccaggagctatgctgctcgaaggggagctcgaccggccgcggtttgaagaagcgttccgcgggctcgtagctcgtcatgaaacgctgcgtaccggctttgagatggtaaaaggcgaagcggttcagcggatttacgaagaagccgccttccaggtggaatatgtgcagatcagcgaggagcaggcagaagaaacggtgcgccaattcgttcgtccgtttgatctagcgaagccgccccttctgcgggtaggccttgctgaactggcgccggaccggcacattctaatgttcgatacgcatcatatcgtatctgacggcgtttcgattgacgtactgatcgaagagctcgtccgcttgtacagcggggagcagttggagccgctccgcattcagtacaaagattatgcggtatggcagcaatcggacgagcagaaagctcagcttgccaagcaggaagcctactggctcgacatgttccgcggagaactgccggttttggaattgccgacggactatccgcgcccggctatgcagagctacgagggccgcacgctgcaattgtttatggatagcgagaaaagtgagggtctgaaacggcttgcagccgagaacggcgcaacgctttacatggttctgcttgctggttatacaatattattgcataagtatacagggcaagaagacgtggtggtcggtacgccgattgcaggaagaaatcacagcgacgttcagccgctgatcgggatgttcgtcaataccctggccatccgcagttatccggctgctggtaaaacgttccttgactacttgaaggaaatcaaggagacgacgctgggcgcttttgaacatcagaattatccgtttgaggaactggtggataaggtgaatgtggctcgcgatttaagccgcaatccgctgttcgatacgatgtttgctttgcagaatacagagaatttggaaatccagctccccggactccatttgtcgacgtatgccagcgaagaaattgtttctaaattcgatctcagcttggacgtcacagagatcgaggaaggcttggaatatctgtttgaatacgccactgctctttataaaaccgaaacagtggagaaattggccgctcactacttgcagctgcttgaatccattctccgcaacccgtcggcgacgattgccgagctgggcattttgacaccggcggaaaaagagcaaattcttggcgcgtttaacccggcgcagccggaagcggctcctgcggcggcgttccaccggctgttcgaggaacaggcggagcgcacgccggaagcggcagctgtcgtgtacgagagcgaccggctgacgtatgcagagctgaacgagcgggcgaaccgcttggcggccacggtgcgcgcaagtggcatcggccgggatacgatcgtcggcattctcgccgagcgttcggtggacttgctggtggccgtgctggccgtctggaaagcgggcggggcgtatgtgccgctcgacccggattatccggcggagcgcgtgcggttcatgctcgaagacagcggagcgaaggtgctgctgacgcaaacgctgctgcgagagcgcgccgaagcctggctcggcgaagaggagctggcgctggcggcggtgctgtacctggacgacgaagcgtcgtacagcgaggagcgggcgaatgcgccgctggaagcggatgatcacttgcacgaatgccgtccggaggacctggcgtacgtgatctacacgtcgggaacgacgggcaagccaaagggcgtgatgatcgagcaccgcagcctggtgaacacggcggcgggctaccggcgggaataccagttgaatcagttcccggtgcggctgctgcagctcgccagcttctcgttcgacgtgttcgtgggagatatcgcgcggacgctgtacaacggaggcacgatggtgattgtgccgaaggacgaccggatcaatccgtctcgtctgcactactggatcagccagcagcaagtgacgatcttcgaatcgacgccggcgctgatcgtgccgttcctggagtacgtgcacgagcatcaactggatatgagcgggatggagctgttgatcacgagctcggacagctgcagcgtggcggattaccgcaccttgcaggaacgcttcggctcgttgttccggatcatcaacgcatacggcgtgacggaagcggcgatcgactccagcttctacgacgaggagctggcgaagctgccacaaacaggcaatgtgccgatcggcaaagcgtggctgaatgcgaaattctacatcgtggatgcgcatctgaatccggtgccggtcggggtgctgggcgagctggtcatcggcggagtcggagtggcgcgcgggtacttgaaccgtccggagctgacggaagagaagttcgtagacagcccgttcgccgcgggcgagcggctgtaccgcacgggagacttggcgcggtggatggaagacgggaacgtggacttcatcggccggatcgacaaccaggtgaaaatccgggggtaccggattgagacaggcgaagtcgaagcgaagctgctgagtgtaggtggcgtgaaggaagcggtcgttgtcgtcagggaagatcaagaaggtcagaaagctttgtgcgcttattatacagcggaagaagacttgacggcggcggacctgaagcgggcgattgccagcgagctgccggggtacatgatcccgtcgtacttcgtggagctggagcgcctgcctctgacgccgaacggaaagatcgaccggaaggcgctgccggcaccggaagggggagcaggcggaggccgcgaatacgtggcgccgcgcaccgaactggaggcgaagctggccgccatttggcaggatgtgcttgttcgggagaaggcggtaggcgtaacggataacttcttcgacctcggcgggcactccctgcgggcgacgacgctggtcagcaaaatgcataaggagctaggcgtggaattcccgcttcgcgacgtattccgctactcgacggttgaagaaatggccacggctatggagcggctggagatcggctcgttcacggctattccggctgcggaacctagcgagtattatccgctctcttccgctcagaaacgtctctatatcttgaaccagctggaaggagccgagctgagctacaacataccaggagctatgctgctcgaaggggagctcgaccggcagcggtttgaagaagcgttccacgggctcgtagctcgtcatgaaacgctgcgtaccggctttgagatggtaaaaggcgaagcggttcagcggatttacgaagaagccgccttccaggtggaatatgtgcagatcagcggggagcaggcggaagaaacggtgcgccaattcgttcgtccgtttgatctagcgaagccgccccttctgcgggtaggccttgctgaactggcgccggaccggcacattctaatgttcgatacgcatcatattgtatctgacggcgtttcgattgacgtactgatcgaagagttcgtccgcttgtacagcggggagcagttggagccgctccgcattcagtacaaagattatgcggtatggcagcaatcggacgagcagaaagctcagcttgccaagcaggaagcctactggctcgacatgttccgcggagaactgccggttttggaattgccgacggactatccgcgcccggctatgcagagctacgagggccgcacgctgcaattgtttatggatagtgagaaaagtgagggtctgaaacggcttgcagccgagaacggcgcaacgctttacatggttctgcttgctggttatacaatgttactgcataagtatacagggcaagaagacgtggtggtcggtacgccgattgcaggaagaaatcacagcgacgttcagccgctgatcgggatgttcgtcaataccctggccatccgcagttatccggctgccggtaaaacgttccttgactacttgaaggaaatcaaggagacgacgctgggcgcttttgaacatcagaattatccgtttgaggaactggtggataaggtgaatgtggctcgcgatttaagccgcaatccgctgttcgatacgatgtttgctttgcagaatacagagaatttggaaatccagctccccggactccatttgtcgacgtatgccagcgaagaaattgtttctaaattcgatctcagcttggacgtcacagagatcgaggaaggcttggaatatctgtttgaatacgccactgctctttataaaaccgaaacagtggaaaaattggccgctcactacttgcagctgcttgaatccattctccgcaacccgtcggcgacgattgccgagctgggcattttgacaccgtcggaaaaagagcaaattcttggcgcgtttaacccggcgcagccggaagcggctcctgcggcggcgttccaccggctgttcgaggaacaggcggagcgcacgccggaagcggcagctgtcgtgtacgagagcgaccggctgacgtatgcggagctgaacgagcgggcgaaccgcttggcggtcacgctgcgcacaagcggcatcggccgggatacgatcgtcggcattctcgccgagcgttcggtggacttgctggtggccgtgctggccgtctggaaagcgggcggggcgtatgtgccgctcgacccggattatccggcggagcgcgtgcggttcatgctcgaagacagcggagcgaaggtgctgctgacgcaaacgctgctgcgagagcgcgccgaagcctggctcggcgaagaggagctggcgctggcggcggtgctgtacctggacgacgaagcgtcgtacagcgaggagcgggcgaatgcgccgctggaagcggatgatcacttgcacgaatgccgtccggaggacctggcgtacgtgatctacacgtcgggaacgacgggcaagccaaagggcgtgatgatcgagcaccgcagcctggtgaacacggcggcgggctaccggcgggaataccagttgaatcagttcccggtgcggctgctgcagctcgccagcttctcgttcgacgtgttcgtgggagatatcgcgcggacgctgtacaacggaggcacgatggtgattgtgccgaaggacgaccggatcgatccgtctcgtctgcaccattggattgagcaggagcgggtcaccatcttcgaatcgacgccggcgctgatcgtgccgttcctggagtacgtgcacgaacataggctggatatgagctggatggagctgttgatcacgagctcggacagctgcagcgtggcggattaccgcaccttgcaggaacgcttcggctcattgttccggatcatcaacgcttacggcgtgacggaagcggcgatcgactccagcttctacgacgaggagctggcgaagctgccgcagacaggcaatgtgccgatcggcaaagcgtggctgaatgcgaaattctacatcgtggacgcgcatctgaacccggtgccggtcggagtgctgggcgagctggtcatcggcggagtcggagtggcgcgcgggtacttgaaccgtccggagctgacagaagagaagttcgtagacagcccgttcgccgcgggcgagcggctgtaccgcacgggagacttggcgcggtggatggaagacggcaacgtggacttcatcggccggatcgacaaccaggcgaaaatccgggggtaccggattgagacgggcgagatcgagtcgcagctgctgcgggtggaaggcgtgcgcgaagcggtggtgctggttcgaagtgatgcgaacgggcagaaagcgctgtgcgcgtactacacaacggatggggaactgacggtggcagacctgaaacgggcgatctccagcgagctgccgggttacatgatcccgtcgtacttcgtcgagctggagcgcctgcctctgacgccgaacgggaaaatcgaccggaaggcgctgccggcgccggaagggggagcaagcgcaggccgcgaatacatggccccgcgcaccgaactggaggcgaaactggtcgccatctggcaggatgtgctcggaccggtcacgattggcgtgacggacaacttcttcgacctcggcgggcactccctgcgggcgacgacgctagtcagcaaggtgcacaaggaactgagtgtggacttgccactgcgcgaagtgttccggcactcgaccatcgaagcgatggccgaggcgatcagccaattggagcggcaggaacacctctccattccggttctggataagagggattactatccgctttcctccgtgcaaaaacggctgtacatccagcagcagatggaaggcgccgagcttagctacaacatgtccggcatgacggttctcgtcgggcgattggaacggaatcaattcgaggcggcgctcaaaggattgatagctcgtcacgaaattttgcgaaccggcttcgaaatggtcgacggcgaaccagtacaacggatttatccgaacttgaagtttgccgtcgaatatacgaaagcgacggaaagtgaaacgaagagcatcgtagacggctttgtgcgcgtctttgatttggagcggccgccgctgctgcgtgtgggcttagtcgaatgggaagcggaacggcatctgctcatgctggacattcatcatatcgtcacggatggcatgtcgatgggcatcttcgtcgaagagctgctgcgcctgtataacggtgagactctggagccgcttcggattcaatacaaggaattcgccgcttggcagcagtcggaacctgtaaaagagcggctgaaacgtcaggaagcctactggctggacgtgctggaaggcgaactgccgacgcttgaactgcctacggactttgtcagacctgccgctcgcagctttgagggagatgtgctgcccttcagcatcgacaagcagatgaccgacagcttgcagcgcatcgccgataagaacggtgctaccctttatatggtgttattggcggcctattcaatcctgctcagcaagtactcgggacaagaagacttcattgtaggcatgccggtttcgggccgcacacatgccgacctggagccgctcatcggaatgtttgtcaacactttggcgattcgccattatccgtccggggagaaggcgttcctcgcttacttgaacgaagtcaaagaaacgatgctgggggcctacgaccaccaggattatccgttcgaggagcttgtgaaaaagctgcaggcgccgcgagatcaaagccgcaatcctgtattcgatgtcatgtttgctctggaaaccaaggaagataacgttcaaagcttcggggatatcaagatcgaatcttatccggaaactcatacggtttcccaatttgatcttaccttggtcatttcgttgctggatgagggaatgaacgggcagtttgaatatgccaccaagttgtttacgcgcaatctgatcgacaatttcgctcaggacctgctcatgatcatcacccaaatttgcgaacagccttcggtgctgttgaaggatatttccctgaacgggcaatccgaacaggagcaagatgtgctagaggccattgatattattttc

SEQ ID NO: 10 - protein, 4953 aa, Paenibacillus polymyxa E681
MAFEKETLFWNEKFGNDDYTLTRLPYSKAPSSLAPIMTTVGGSLSEEAAQRVLQMSKGAPLAAFMILLAGVQSLLHKYTGASDILVGMPVVRKPTETRRSVNHTVILKNSLSAGATFKTLLNELRTSLPRAIQHQHIPFLKMTEKLDLQYADGIPVVHTLVSLKELHLDEIGQNVVTDCSFEFSLTGGTIQLALSYNEHLYDSEFMTRVVGHLNRLLVVGLHELELDIVRADMLSEDEKFQLLQSFNDTEKDYPRDRTIHQLVEEQAKRVPEATAVVFEGRRLSYAELNERANRLARTLRSIGVLPNQLVGLMVRRSLETVVGILAVLKAGGAYVPIDPEYPEERIRYILENSNAQLLLTQRELLQLQVPFEGTVVALDDEQAYSDDGSNLEPASGPNDLAYVIYTSGTTGNPKGVMLEHHGLVSLKLMFADRLGITEHDRIVQFASLSFDASCWEVFKALYFGAALYIPTAETILDNRLFESYMNEHAITAAILPPTYSAYLNPDRLPSLTKLVTGGSAVSAEFVQQWKRKVHYFNAYGPTEASIVTTLWDADEEQPEGRVIPIGRPLANHRIFILDAHLQLVPPGVDGELCVAGVGLARGYLNHPELTAEKFVEHPFAPGERLYRTGDLARWLPDGNVEYLGRIDHQVKIRGFRIEIGEIEEQLLKIDSVQETIVIAREGKSGQELCAYLVAGRPLTLGELRSALAQKLPNYMIPAHFVQLPQMPLTPNDKIDRKALPAPEGNALTGGAYVAPRNEAERTLADVWQAVLNADRVGVTDHFFELGGDSIKSIQVSSRLHQAGYKLEIRDLFKYPTISQLSLHVKPIGRTIDQGEITGETALTPIQHWFFESSFADPHHFNQSVMLYRKERFDEETVRQVLQKLAEHHDALRMVFRKTEQGFSARNRAIQDGGLFTLDVFDFKDAENTEQAVEAKATDIQAGIDLENGLLLKAGLFRCADGDHLLLAVHHAVVDGVSWRILMEDFALGYEQAGKSEEIRFPAKTDAYRTWSEQLAAYAQSPEMTKERAYWQAMEQIAVPAVPKDLDVDVTTQQDSESLFVRLTPEETELLLKRVHRAYNTEMNDILVTALGIAIRKWTGHERVRINLEGHGRESIGTDIDITRTVGWFTTKFPVVLEPETDRDLAYQIKQVKESLRRIPNKGLGYGVCRYLSKSEDGFVWGAEPEINFNYLGQFDDDVSQVEIGISSYSSGSPASDRQARSFVLDINGMVLDGALSLDLSYSRKQYRKETMEAFAQRLEQSLRELITHCAGKENTELTPSDVQFKGLTIAELEQIAQRSGHLGEIENIYSLTPMQKGMWFHSALDRQTAAYFEQTRFTMRGALDVQLFERSWMELAKRHLVLRANFVKGPEGEPLQVIYRDKPVGFEYEELLHLQADEKQAYLDKKAEDDKLRGFDMEHDALVRVTILRTEEQSYHVLWSFQHILMDGWCLPQLTQELFEMYSALASGKQPAGDKGSDYGAYIEWLEKQDDQAASGYWTAFLADYEGQTVLPGQKEPAPSGIFTADHVTAELGKDLSERMDRVAKQRLVTVNTLLQAAWGVMLQKYNGTNDAVFGSVVAGRPAEIPGIESMIGLFINTVPVRVTSEADTVFADLMAKLQERALESGRYDYYPLYEIQARSVQKQNLINHIIAFENYPVDEQMEQAGDQQHGDLTIADVQMEEQTNYNFNVTVVPGVEIEIRFDFNAEVFDKDSIERLKGHLVHLLEQVTDNPEITVGELELVTEGEKADLLGRFNDTTTEFPRGKTLVQLFEEQAELYPDNVAAVMNERQLTYRELNERSNRLARKLRETGVEADQLVAILAERSLDMVVGILAILKAGGAYVPVDPDYPEERIRFMIEDSGAPLLLIQKHLHEKTDFAGTRLELDDFVWGDRGADSADALDASNLEPISGPGNLAYVIYTSGTTGRPKGTLIEHKNVVRLLFNDKNLFDFGPSDTWTLFHSFCFDFSVWEMYGALLYGGKLVIVPSLTAKNPADFLALLGREQVTILNQTPTYFYQLLREVLADHPYDLRIRNVIFGGEALSPLLLKGFKTKYPETKLINMYGITETTVHVTYKEITWVEMEAAKSNIGKPIPTLRVYVLDENRRPVPIGVAGEMYVAGEGLARGYLNRPDLTAEKFVDSPFAEGEKLYRSGDLAAWLPDGNIEYLGRIDHQVKIRGYRIELDEIETQLLNVRGVEEAVVLARQDGGGEKALVAYFVADRTLTVSEMRTSLAQGMPGYMIPSYFVQLERMPLTTNGKVDRKALPEPQGGIQTGVEYVAPRNWTESQLVKIWEEVLGYSGIGVLDNFFELGGHSLRATNLVSKIQKEMNVELPLRDVFRYSTIEEMALAISRIGEQSFSSIPLAGARAYYPLSSAQKRLFILNQLEGADQSYNMPGVLLLEGSIDRSLLEKAFRGLIARHETLRTGFEIVQGEAIQRIYESVDFAVEYRHASEEEAPEVVQAFIRPFDLAKPPLLRAELVELAAERYLLMFDMHHIVSDGVSMDVLVEELVRLYGGESLEPLRIQYKDYAVWQQSDEQKVQLKREEAYWLDRYRGELPVLEMPTDYPRPAVQSFEGQTLTSFVDEATNEGLKQLAAQRGTTLYMVLLAAYTVLLHKYTGQDDLIVGTSIAGRTHGDTQPLIGMFVNTLALRNYPASKKTFLSYLEEVKETTLGAYEHQNYPFEELVDKVQVSRDLSRNPLFDTMFSLQNLEDKEFELEGLKLSSYPSEYGTAKFDLSVDVTEENGGLECSFEFATALYKESTIRRLSTHFGHLLAAIASRPDAKIAELNLLTAEEKEQILGAFNPAQLEAAPAAAFHRLFEEQVERTPEEAAVVYENERLTYAELNERANRLAATLRASGIGRETIVGILAERSVDLLVAVLAVWKAGGAYVPLDPDYPADRVRFMLEDSGAKVLLTQTALRERAEAWLGEEELALAAVLYLDDEASYNEERANAPVGSGMVSGKLTDAVDDGDESHQNVDTDGFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHEQRLDMSWMELLITSSDSCSVADYRTLQERFGSLFRIINAYGVTEAAIDSSFYDEELTKLPQTGHVPIGKAWLNAKFYIVDAHLNPVPVGVLGELVIGGVGVARGYLNRPELTEEKFVDSPFAAGERLYRTGDLARWMEDGNVDFIGRIDNQAKIRGYRIETGEIESQLLRVEGVREAVVLVRSDANGQKALCAYYTPDTGAELAVNDLRGALAQELPGYMIPSYFVELERLPLTPNGKIDRKALPAPEREAGSGTEYVAPRNELETKLTAIWQEVLGLAKEIGVHDNFFDIGGHSLRATTLVSKIHKELNVDLPLRDVFRHSTIESMAAAISRLDEQTFVAIPVADDREVYPQSFAQKRLFILNQLEGAELSYNMPEAMLLEGALDRTRFEEAFRKLVARHETLRTGFEMVDGEASQRIYQDVNFAVEFYRVDEQEAEETVHRFVRPFDLAKPPLLRVGLVELAPERHILMYDMHHIISDGVSMEIFVEEFVRLYGGEQLEPLRIQYKDYTVWQHSQEQKERLQRQEAYWLDMFQGELPVLEMPTDYPRPAVQSYEGQTLEFFFDASKTDGLKQLASETGTTLFMVLLAAYNVLLHKYSGQEDVIVGTPIAGRNHGDVQPLIGIFLNTLAIRSYPASEKTFLSYLNEVKETTLHAFEHQNYPFEELVDKVQVTRDLSRNPLFDTLFTMQNTENEEFELEGLRLIPYPSALDTAKFDISLDVGEENGGLDYSFEYATALYKRETIERLAKHYEQLLVTIVSRPDAKIAELNLLTAEEKGQILGAFHPAQLEAAPAAAFHRLFEEQAERTPEAVAVVYENDRLTYAELNERANRLAATLRASGIGRETIVGILAERSVDLLVAVLAVWKAGGAYVPLDPDYPAERVRFMLEDSGAKVLLTQTPLRERAKAWLGEEELALAAVLYLDDEASYSEERANADSFHEARPEDLAYVIYTSGTTGKPKGVMIEHRSLVNTAASYRREYRLDQFPVRLLQLASFSFDVFVGDIARTLYNGGTMVIVPKDDRIDPSRLHYWMEREQVTIFESTPALIVPFMEYVHEQGLDMSWMELLITSSDSCSVADYRTLQERFGSLFRIINAYGVTEAAIDSSFYDEELAKLPQTGHVPIGKAWLNAKFYIVDAHLNPVPVGVLGELVIGGVGVARGYLNRPELTGEKFVDSPFAAGERLYRTGDLARWMEDGNVDFIGRIDNQAKIRGYRIETGEIESQLLQVEGVREAVVLVRSDANGQKALCAYYTPDTGAELAVNDLRGALAQELPGYMIPSYFVEMERLPLTPNGKIDRKALPAPEGEAGSGTEYVAPRNELETKLTAIWQEVLGLAKEIGVHDNFFDIGGHSLRATTLAGKVFKELNVNLPLRDVFRHSTIAAMAEAIARMERREHEAIPQAEEREYYPLSSAQKRLFIQHTLDGADQLYNMPELVQVEGEFDLERLEAALRKLITRHESLRTGFEIVKGEAVQRIYPQVDFAIEHYQADKEDAAQIEQIVRSFVRPFDLGKPPLLRAGVIELEPNLHILLFDMHHMVSDGVSMAIVIDEFSSFYAGEELPPLRIQYKDYAVWQQSKAHRERIGRQEAYWLQTFEGELPTADLPMDYERSAARSYEGAHLEFDVEASLSAQLRELAAERESTLFMVLLAAYTVLLSKYSGQEDLVVGTPVAGRTNADLEPIIGMFVNTLAIRNRPSGDKTFLSYLEEVKETALGAFENQDYPFEELVERLNVKREPGRFPLFDAVFDLQNIEERDAELEGVSLKTYELDHLEEAKFDLTLFMYENNGALSGGFFYATKLFKEAMIRTLTEDYLRVLSQIAKNPQLELSRIECHKPAAGAKSAVDTIEFAF

SEQ ID NO: 11 - protein, 1102 aa, Paenibacillus polymyxa E681
MKSLFEKEEQYWSGKFDADDSLSFLPYSQSSKLSAHGEAAAEPGLLHRTLPSQLSERIISLANGSDLALYMIVLAGVKSLLFKYTGRDQVLVGMPSYSADPDGTPPPHDILVIKTSVSRQTTLKTLLGGIKASIGEALEHQHLPFRKMVEPLHLDYTGDGLPVVNTVVSFAPIHPEPQGNRVAADTVFRFDRQNHSIELEISFDGQRYERAFVEQAADHLVRLLSVLLFQPDLKLGQADVLSPDERETLLKRFNDTETEFERGKTIYGLFEEQAELYPDNVAAVMNERQLTYRELNERSNRLARKLREAGVEADQLVAILAERSLDMVVGILAILKAGGAYVPVDPDYPEERIRFMIEDSGAPLLLIQKHLHEKTDFAGTRLELDDFVWGDRGANSAEALDASNLEPISGPGNLAYVIYTSGTTGRPKGTLIEHKNVVRLLFNDKNLFDFGPSDTWTLFHSFCFDFSVWEMYGALLYGGKLVIVPPLTAKNPADFLALLGREQVTILNQTPTYFYQLLRKVLADHPYDLRIRNVIFGGEALSPLLLKGFKTKYPETKLINMYGITETTVHVTYKEITWVEMEAAKSNIGKPIPTLRVYVLDENRRLVPIGVAGEMYVAGEGLARGYLNRPDLTAEKFVDSPFAEGERLYRSGDLAAWLPDGNIEYLGRIDHQVKIRGYRIELDEIETQLLNARGVEEAVVLARDDAHGHKQLVAYYVAETRLAANELKEELAKQLPGYMIPSHLVQLSRMPLTPNGKIDRKALPAPEEAAAGGAEYVAPRTLLEMKIVRVWQDTLGVPQVGVKDNFFELGGNSLSLMRLVQAVYDETGIEIPLNRQFHNVTVEAMAFGEGDLGLDKGGDSFIKLNKAGDLNVFCFPPGSGFGIGYRELASRLDGRFVLYGIDFIDDAADYEAMLNRYVDEIVRIQPEGPYVLLGYCFGGNLMFEVAKTMEKREYSVTDVLMVDSWIKDTLTPSETSEKELEETLADFDEEEKELMSNPLVRERVHRKVKATLAYEAQLMNSGTIPARIYELIAKDSEAFRLEHQLPSWRGATTQAYADYRLEGAHEELLELARVDETAVVIRDILEQVKRQIEAEAGVLHGS

SEQ ID NO: 12 - protein, 6312 aa, Paenibacillus polymyxa E681
MRENTKEQYGLTQAQRRIWFMEIMNPGTSITMLSATYQITGEINTQLLEQAAAEIVKTYDVFRIRISGDLQNPTQWFEEPENVQARISRLEIGTTEQFYAWVKEVSEKPASVFDEHLHQFTIIHFVNGQVWLNLTVNHIIADGLSVNALLHAVMEKYLELRKGISSSYQAPSYLDYISAEREYEQSQRYQKGKEYWLTKYNTLPETTGIKSYPPFSIGSESNKLSITLDGSRYERILTFSEQYQVSLYTLFLSAMYALLYKLTDSIDVPVGTVFANRTSKKEKETIGMFVSTVATRIRLNPDRNVLSLIQTVSKENTADLRYQKYPYNQLIQDLREQHGRNDLSGLFRTSLEYLPLKIVEYEEIKVRLEAHFARHEMDDLLLRFDHMLNEGHVILHASYRTGLFETAEIDRIMEQYVTVLDQFLQTPELPIREISLLSDEERHRILNVFNPPVAGLSEGEAFHRYVEKFAREIPDHPAVVYMDKQLTYGELNERAERLASLLREQGVGKETITGIWAERSVELLVGVLAVWKAGGAYVPLDPDYPAERIEYMLSDSDASVLLTQRHLLERAGGWLADDRLKLQAVYAMDDEQIYNGDALAVEFESAGSAPQDLAYVIYTSGTTGRPKGVMIEHGSLVNTADAYRREYRLDQFPVRLLQLASFSFDVFVGDIARTLYNGGTMVIVPKDDRIDPNLLYGWIRDQNITVFESTPALILPFMQHIYEEGLDVSSMQLLITSSDACSVTDYRLLQERFGGQFRIINSYGVTEAAIDSSFYGEPLDKLPPSGHVPIGKAWLNARFYIVDAALKPVPVGVPGELVIGGAGVARGYWNRPDLTAEKFADSPFVPGERLYRTGDLARWLEDGNVDFIGRIDYQVKIRGFRIELGEIETALLRFPGVKQAVVTDRTDEQGEKYLCGYVAADASLQLSDLLSQLKQELPAHMVPARLVSLDKLPLTPNGKIDRKALPEPTGEVEAGREYVAPRTTLETRLALIWQQVLGIARVGVQDDFFDLGGHSLRASTLVSKIRKELQVEVPLREVFRYTTIEQLAQRIGGLRQQETYEITKAAEAEYYPVSSEQKRLYVLRQLDGAERSYNMSAALLLEGKLDRMRVEHAFRALIQRHETLRTGIEQVQGELVQRIYDEVEFAVDYFQASEREVEQVVEAYYHPFDLTKPPLLRIGLIEVAEDRHILLFDMHHIVSDGISTALLFDEFSRLYRGEELGPLRIQYKDYAVWQHSEAYGQMLQPQKEYWLEQLSGELPVLELPTDFPRPAVQSFDGRTVKFYIEKDRTEKLKELAARTGTTLYMVLLSAYTILMHKYSGQEDLIVGTPIAGRTQEEVQPIVGMFINTLAIRSRPERSKPYLSYLEEIKDITLGAFEHQNYLFEDLVESLHIPRATGRNPLFDTFFSLQNTENEQIVIEGLEQSFYPLENQTSKFELLLDISELDGQLECRLEYATALYKQETAERFARHYDKLLETIAAAPDGDIASLEMLKEEEIRELVRGFNDSEADYPRQQTIHGLFEEQAELYPDNVAAVMNERQLTYRELNERSNRLARKLRETGVEADQLVAILAERSLDMVVGILAILKAGGAYVPVDPDYPEERIRFMIEDSGAPLLLIQKHLHEKTDFAGTRLELDDFVWGDRGANSAEALDASNLEPISGPGNLAYVIYTSGTTGRPKGTLIEHKNVVRLLFNDKNLFDFGPSDTWTLFHSFCFDFSVWEMYGALLYGGKLVIVPPLTAKNPADFLALLGREQVTILNQTPTYFYQLLREVLADHPYDLRIRNVIFGGEALSPLLLKGFKTKYPETKLINMYGITETTVHVTYKEITWVEMEAAKSNIGKPIPTLRVYVLDENRRPVPIGVAGEMYVAGEGLARGYLNRPDLTAEKFVDSPFAEGEKLYRSGDLAAWLPDGNIEYLGRIDHQVKIRGYRIELDEIETQLLNVRGVEEAVVLARQDGGGEKALVAYFVADRTLTVSEMRTSLAQGMPGYMIPSYFVQLERMPLTTNGKVDRKALPEPQGGIQTGVEYVAPRNWTESQLVKIWEEVLGYSGIGVLDNFFELGGHSLRATNLVSKIRKEMNVELPLRDVFRYTTVESMAGAIASLEETQHSSIPKAEEKAYYPVSSAQKRLYVLHQLDSSELNYNLPSALQLEGALNEAKVEKALTTLVARHDMLRTGFEIVNGEPVQRIHPLVAFKVEKLQASEDQVAAILEGFIQPFDLTQPPLLRALLIELEKEKFLLALDIHHIGSDGLSMDVLLREFVRLYNGEELPELRIQYKDYAVWQQSEEQRQRIKRQEEYWRGVFSSELPVLELPLDFSRPAVQQFDGQTLTFTLDAEKSEALKRLAGDSGATLYMLLLAAYSVLLHKYAGQEDIVVGTPIAARSHADLQPIIGMFVNTLALRLRPAAERTFLDYLQEVKETTLGAYEHQDYPFEELVEALQVSRDLSRNPLFDTMFSLQKHESLDLTLEGLQWSLFDIEEKTAKFDLSFDIVEADNELVCKIEYATSLFRQETMVRLAGHYEQLLASILAQPGARISDLDILTDSEKHDLLVGFDVSSSALAKQPAAEGTGLEADESWRERTFHELFEEQAERTPGALAVVYEDSKLTYAELNAKANRLAYALRARGVKPEQVVGILAGRSAELLVGVLAVWKAGGAYVPLDPDYPAERIEYMLADSGASVLLTQTCLLEQAEAWRSDGALVLQTVLALDDAATYSLGAAEAAVGVQALGEAGAEAEALAQAETAAAEKSATAEAEKNVLAADLASNPANVNKPSDLAYVIYTSGTTGRPKGVAVEHRSLVNTAAGYRRDYRLDQFPIRLLQLASFSFDVFVGDIARTLYNGGTMVIVPKDDRIDPTRLYGWIRDYAVTVFESTPALIVPFMEHVHAEGLDLSSMQLLITSSDACSVADYRTLQERFGSQFRIINSYGVTEAAIDSSFYDEPLEKLPKTGSVPIGKAWLNAKFYIVDANLKPVPIGVLGELVIGGAGVARGYLNRPDLTAEKFVDSPFAAGERLYRTGDLARWMPDGNVDFIGRIDNQVKIRGYRIELGEIEAAMKNFAGVRQALVIDRTDERGQKYLCGYVVADSSFDLEGLVAHLDAALPSHMVPSRIMRLDQMPLTPNGKIDRKALPVPEGSIRAEAAYTAPRTPAEQALASVWQSVLGVDQVGTMDNFFALGGDSIKALQVSSRLLQTGYKLVMKDLFHYPTISALSLQLQTAERTASQAEVTGEVILTPIQRWFFEQNPADVHHSNQAFMQFSKEGFDEEALRQAVRQIVVHHDALRTVYRQADNGYTAWNRGAGENEALFDLEVVDFKGVGDVKEAVEAKANDIQASIDLENGPLVKLGLFRCDDGDHLLIAIHHLVVDGVSWRILLEDFAAGYEQALQGQPIRLPLKTDSFQTWAKQLADYANSPAMESEREYWQHIEQLTYEPLPKDFEQGRSKLKDSGLVTVRWTAEETEQLLKQAHRAYHTEMNDLLLAALGLALQAWSGRERVLVNLEGHGREDILPDVDITRTVGWFTSQFPVVLEPGHAQALGHQVKQVKESLRRIPNKGIGYGILRYLSAPREGEYFVLEPEISFNYLGQFDHDYESSSSQPSPFSPGSDSSPNAVMDYVLDINGMVSEGALELTIRYGETQYKRETVERLGTLLQSSLREVISHCLSKERPELTPSDVLLQDVTVEELERLSEHTVALGELENVYTLTPLQKGMLFHSLLDADSEAYFEQVTFDLYGSLNVEAFTRGLDTLVQRNEALRTNFITGWRDEPIQVVFRERKCEVYFEDIRSVSDEHPEKTIADFVSADKANKFDLARGPLMRVTVVRTGDESYHVIWSHHHILMDGWCMSFMIKEVFDTYFAFQEKRTLELPPVTSYSRYIEWLEAQDAAKASRYWSEYLAGYDQQTKLPQEKTQLKQGAFEAAEIDVELSKELTGQIERVARQQQVTLNTFMQTVWGLVLQIYNNSEDVVFGSVVSGRPAEIPGIESMIGLFINTIPVRIQGKAEERVADILRKTQDQALASGAYETFPLFEIQSLSEQKRDLINHIMVFENYPMEEQIEQVVGGGREALKIANIQSPEQTNYDLDITVIPEEHILLRFTYNALTFREDDIRQIHSHFAWALEKVAANPNILVNQLELLTAAEKEQILGAFNPAQPEAAPAAAFHRLFEEQVERTPEEAAVVYENDRLTYAELNERANRLAATLRASGIGRETIVGILAERSVDLLVAVLAVWKAGGAYVPLDPDYPADRVRFMLEDSGAKVLLTQTALRERAEAWLGEEELALAAVLYLDDEASYNEERANAPVGSGMVSGKLTDAVDDGDESHQNVGTDGFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHDQQLDMSWMELLITSSDSCSVADYRTLQERFGSLFRIINAYGVTEAAIDSSFYDEELAKLPQTGHVPIGKAWLNAKFYIVDAHLNPVPVGVLGELVIGGVGVARGYLNRPELTGEKFVDSPFAAGERLYRTGDLARWMEDGNVDFIGRIDNQAKIRGYRIETGEVEAKLLSVGGVKEAVVVVREDQEGQKALCAYYTAEEGLTAADLKRAIASELPGYMIPSYFVELERLPLTPNGKIDRKALPAPEGGAGGGREYVAPRTELEAKLAAIWQDVLVREKAVGVTDNFFDLGGHSLRATTLVSKMHKELGVEFPLRDVFRYPTVEEMAAAMERLEIGSFMAIPAAEPSEYYPLSSAQKRLYILNQLEGAELSYNIPGAMLLEGELDRQRFEEAFRGLVARHETLRTGFEMVKGEAVQRIYEEAAFQVEYVQISAEQAEETVRQFVRPFDLAKPPLLRVGLAELAPDRHILMFDTHHIVSDGVSIDVLIEELVRLYSGEQLEPLRIQYKDYAVWQQSDEQKAQLAKQEAYWLDMFRGELPVLELPTDYPRPAMQSYEGRTLQLFMHSEKSEGLKRLAAENGATLYMVLLAGYTILLHKYTGQEDVVVGTPIAGRNHSDVQPLIGMFVNTLAIRSYPAADKTFLEYLKEIKETTLGAFEHQNYPFEELVDKVNVARDLRRNPLFDTMFALQNTENLEIQLPGLHLSTYASEEIVSKFDLSLDVTEIEEGLEYLFEYATALYKTETVEKLAAHYLQLLESILRNPSATIAELGILTPAEKEQILGAFNPAQPEAAPATAFHRLFEEQVERTPEEAAVVYENDRLTYAELNKRANRLAATLRAGGIGRETIVGILAERSVDLLVAVLAIWKAGGAYVPLDPDYPADRVRFMLEDSGAKVLLTQTPLRERAEAWLGEEELALAAVLYLDDETSYSEERANAPIGSGMVSGKLTDAVNDGDESHQNVGTDSFHEARPENLAYVIYTSGTTGKPKGVMIEHRSLVNTAVGYRREYRLDQFPVRLLQLASFSFDVFVGDIARTLYNGGTMVIVPKDDRIDPSRLHHWMERERVTIFESTPALIVPFLEYVHDQQLDMSWMELLITSSDSCSVADYRTLQERFGSLFRIINAYGVTEAAIDSSFYDEELAKLPQTGHVPIGKAWLNAKFYIVDAHLNPVPVGVMGELVIGGVGVARGYLNRPELTEEKFVDSPFAAGERLYRTGDLARWMEDGNVDFIGRIDNQAKIRGYRIETGEIESQLLRVEGVREAVVLVRSDSNGQKALSAYYTIDGELTAADLKRAISSELPGYMIPSYFVELERLPLTPNGKIDRKELPAPEGGASAGREYVAPRTELEAKLVAIWQDVLGPITIGVTDNFFDLGGHSLRATTLVSKVHKELSVDLPLRDVFRHSTIEAMAEAISQLERQEHLSIPVLDKRDYYPLSSVQKRLYIQQQMEGAELSYNMSGMTVLVGRLERNQFEAALKGLIARHEILRTGFEMVDGEPVQRIYPDLKFAVEYTKAMESETKSIVDGFVRVFDLERPPLLRVGLVEMEAERHLLMLDIHHIVTDGMSMGIFVEELLRLYNGETLEPLRIQYKEFAAWQQSEPVKERLKRQEAYWLDVLEGELPTLELPTDFVRPAARSFEGDVLPFSIDKQMTDSLQRIADENGATLYMVLLAAYSILLSKYSGQEDFIVGTPVSGRTHADLEPLIGMFVNTLAIRHYPSGEKTFLAYLNEVKETMLGAYEHQDYPFEELVKKLQAPRDQSRNPVFDVMFALETKEDNVQSFGDIKIESYPETHTVSQFDLTLVISLLDEGMNGQFEYATKLFTRNLIDNFAQDLLVIITQICEQPSALLKDISLNGQSEQEQDVLEAIDIIF

SEQ ID NO: 13 - protein, 4959 aa, Paenibacillus polymyxa F4
MAFEKETLFWNEKFGSDDYTLTRLPYSKAPSSLAPIMTTVGGTLSEEVAQRVLQMSKGAPLATFMILLAGVQSLLHKYTGASDILVGMPVVRKPTETRRSVNHTIILKNSLSAGATFKTLLSELRTSLPEAIQHQHIPFLKMTEKLDLQYAGGIPVVHTLVSLKELHLDEIGQNVVTDCSFEFSLTGGTIQLALSYNEHLYDSEFMTRVVGHLNRLLAVGLHELELDIVRADMLSEDEKFQLLQSFNDTEKDYPRDRTIHQLVEEQAKRVPEATAVVFEGRRLSYAELNERANRLARTLRSVGVLPNQLVGMMARRSLETVVGILAVLKAGGAYVPIDPEYPEERIRYILENSNAQLLLTQRELLQQVPFEGTVVALDDEQAYSDDGSNLEPASGPNDLAYVIYTSGTTGKPKGVMLEHRGLVSLKLTFAHTLHTTEQDRVLQFASLSFDASCWEMFNALYFGATLYIPSTETILDDQLFERFMNEHAITIATLPPTYAAYLNSDRLPSLSRLITAGSAVSAEFVQQWKDKVQYYNAYGPTEASIATSVWAASTHDTERRAIPIGRPIWNHRLYILGAQNQLAPIGVEGELCIAGVGLARGYWNRPDLTAEKFIEHPFEPGERLYRTGDLARWLPDGNIEYLGRIDHQVKIRGFRIEIGEIEEQLLKIDSVQETIVIAREGKSGQELCAYLVAGRPLTLGELRSALAQKLPNYMIPAHFVQLPQMPLTPNDKIDRKALPAPEGNALTGGAYVAPRNEAERTLADVWQAVLNADRVGVTDHFFELGGDSIKSIQVSSRLHQAGYKLEIRDLFKYPTISQLSLHVKPIGRTIDQGEITGETALMPIQHWFFESSFADPHHFNQSVMLYRKERFDEETVRQVLQKLAEHHDALRMVFRKTEQGFSARNRAIQEGGLFTLDVFDFKDAENTAQAVEAKATDIQAGIDLENGPLAKAGLFRCADGDHLLLAVHHAVVDGVSWRILMEDFALGYEQAGKSEEIRFPAKTDAYRTWSEQLAAYAQSPEMAKERAYWQAVEQIAVPAVPKDLEADVTTQQDSESLFVRLTPEETELLLKRVHRAYNTEMNDILVTALGIAVRKWTGHERVRINLEGHGRESIGTDIDITRTVGWFTTKFPVVLEPETDRDLAYQIKQVKESLRRIPNKGLGYGVCRYLSKSEDGFVWGAEPEINFNYLGQFGDDVNQDEIGISSYSSGSPASDRQARSFVLDINGMVLDGALSLDLSYSRKQYRKETMEAFAQRLEQSLRELITHCAGKENTELTPSDVQFKGLTIAELEQIAQRSGHLGEIENIYSLTPMQKGMWFHSALDRQTAAYFEQTRFTMRGALDVQLFERSWMELAKRHLVLRANFVKGPAGEPLQIIYRDKPVGFEYEELLHLQADEKQAYLDKKAEDDKLRGFDMEHDALVRVTILRTEEQSYHVLWSFQHILMDGWCLPQLTQELFETYSALASGKQPAGDKGSDYGAYIEWLEKQDDQAASGYWTAFLAGYEGQTVLPGQKEPAPNGRFTADHVTAELGKDLSERMDRVAKQRLVTVNTLLQAAWGVMLQKYNGTNDAVFGSVVAGRPAEIPGIESMIGLFINTVPVRVTSEADTVFADLMAKLQERALESGRYDYYPLYEIQARSVQKQNLINHIIAFENYPVDEQMEQAGDQQHGDLTIADVQMEEQTNYNFNVTVVPGVEIEIRFDFNAEVFDKDSIERLKGHLVHLLEQVTDNPEITVGELELVTEAEKADLLGRFNDTTTEFPRGKTLIQLFEEQAERIPDAAAISLNEQELTYRELNERVNRLARTLRSHGISKGRLVAIMAERSIEMVVGMLAAHKAGAAYVPIDPEYPEERIRFLIEDSGAQVMLTQSRLRERLAGSDSVILLDDESFYHEDGTNLNPGTEATDLACVIYTSGTTGKPKGNLVSHRNIVRIVRNTNYIDITERDHVLQLSSYSFDGAIFDIFGALTNGARLVLVPRETLLEIVRLADLIQRERISVMLITTAFFNVLVDVNVDCLRDVRAILFGGERVSVGHVRKALAHIGPGRLNHLYGPSESTVYTTYLPVDFVDESAVTVPIGRPISNTKVYIVDSRNKLLPIGVAGELCVGGEGLVRGYNNRPELTAEKFVDNPFVLGERMYRTGDLAKWLPDGTIEYVGRTDDQVKIRGFRIELGEIEAQLQKVEGIRKATVFAREDASGEKQLCAYYEADRELPAAELKSVLSQELPAYMIPAYLIQLEQLPLTTNGKVDRRSLPAPEESLQPGEERTPPRTPLEASLAGIWKSVLGLEHIGVHDNFFDLGGHSLRATTLVSKVHQELNVELPLRDVFRYSTIEEMALAISRIGEQSFSSIPLAGARAYYPLSSAQKRLFILNQLEGADQSYNMPGVLLLEGSIDRSLLEKAFRGLIARHETLRTGFEIVQGEAVQRIYESVDFAVGYRHVSEEEAPEVVQAFIRPFDLAKPPLLRAELVELAAERYLLMFDMHHIVSDGVSMDVLVEELVRLYGGESLEPLRIQYKDYAVWQQSDEQKVQLKREEAYWLDRYRGELPVLEMPTDYPRPAVQSFEGQTLTSFVDEATNEGLKQLAAQRGTTLYMVLLAAYTVLLHKYTGQDDLIVGTSIAGRTHGETQPLIGMFVNTLALRNYPASEKTFLSYLEEVKETTLGAYEHQNYPFEELVDKVQVSRDLSRNPLFDTMFSLQNLEDKEFELEGLKLSPYPSEYGTAKFDLSVDVTEENGGLECSFEFATALYKESTIRRLSTHFGHLLVTIVSRPDAKIAELNLLTAEEKEQILGAFNPAQPEAAPASAFHRLFEEQAERTPEAEAVVYENDRLTYAELNERANRLAATLRASGIGREAIVGILAERSVDLLVAVLAVWKVGGAYVPLDPDYPAERVRFMLEDSGAKVLLTQTPLRERAEAWLGEEELALAAVLYLDDEASYSDERANASVVSGKLTDAVDDGDESHQNVGTDSFHEARPEDLAYVIYTSGTTGKPKGVMIEHRSLVNTAAGYRREYRLDQFAVRLLQLASFSFDVFVGDIARTLYNGGTMVIVPKDDRIDPSRLHHWIERERVTIFESTPALIVPFLEYVYEQQLDMSRLELLITSSDSCSVADYRTLQERFGSLFRIINAYGVTEAAIDSSFYDEELAKLPQTGNVPIGKAWLNAKFYIVDAHLNPVPVGVLGELVIGGVGVARGYLNRPELTEEKFVDSPFAEGERLYRTGDLARWMEDGNVDFIGRIDNQAKIRGYRIETGEIESQLLRVEGVREAVVLVRSDANGQKALCAYYTPDTGAELAVNDLRGALAQELPGYMIPSYFVELERLPLTPNGKIDRKALPAPEGEAGSGTEYVAPRNELETKLAAIWQEVLGLAKEIGVHDNFFDIGGHSLRATTLVSKIHKELNVDLPLRDVFRHSTIESMAAAISRLDEQTFVAIPVADDREVYPQSFAQKRLFILNQLEGAELSYNMPEAMLLEGALDRARFEEAFRKLVARHETLRTGFEMVDGEASQRIYQDVNFAVEFYRADEQEAEETVRRFVRPFDLAKPPLLRVGLVELAPERHILMYDMHHIISDGVSMEIFVEEFVRLYGGEQLEPLRIQYKDYTVWQHSQEQKERLQRQEAYWLDMFQGELPVLEMPTDYPRPAVQSYEGQTLEFFFDASKTDGLKQLASETGTTLFMVLLAAYNVLLHKYSGQEDVIVGTPIAGRNHGDVQPLIGIFLNTLAIRSYPASEKTFLSYLNEVKETTLHAFEHQNYPFEELVDKVQVTRDLSRNPLFDTLFTMQNTENEEFELEGLRLIPYPSALDTAKFDISLDVGEENGGLDYSFEYATALYKRETIERLAKHYEQLLVTIVSRPDAKIAELNLLTAEEKEQILGAFNPAQPEAAPAAAFHRLFEEQAERTPEAEAVVYENDRLTYAELNERANRLAATLRASGIGRETIVGILAERSVDLLVAVLAVWKAGGAYVPLDPDYPAERVRFMLEDSGAKVLLTQTPLRERAEAWLGEEELALAAVLYLDDEASYSEERANASVVSGKLTDAVDDGDESHQNVGTDSFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWIERERVTIFESTPALIVPFLDYVHEQQLDMSWMELLITSSDSCSVADYRTLQERFGSLFRIINAYGVTEAAIDSSFYDEPLTKLPQTGNVPIGKAWLNAKFYIVDAHLNPVPVGVLGELVIGGVGVARGYLNRPELTEEKFVDSPFAAGERLYRTGDLARWMEDGNVDFIGRIDNQTKIRGYRIETGEIESQLLRVEGVREAVVLVRSDANGQKALCAYYTPDTGAELAVNDLRSALAQELPGYMIPSHFVETERLPLTPNGKIDRKALPAPEGEAGSGTEYVAPRNELETKLAAIWQEVLGLAKEIGVHDNFFDIGGHSLRATTLAGKVFKELNVNLPLRDVFRHSTIAAMAEAIARMERREHEAIPQAEEREYYPLSSAQKRLFIQHTLDGADQLYNMPELVQVEGEFDLDRLEAALRKLITRHESLRTGFEIVKAEAVQRIYPQVDFAIEHHQADKEDAAQIEQIVRSFVRPFDLGKPPLLRAGVIELEPNLHILLFDMHHMVSDGVSMAIVIDEFSSFYAGEELPPLRIQYKDYAVWQQSKAHRERIGRQEAYWLQTFEGELPTADLPMDYERSAARSYEGAHLEFDVEASLSARLRELAAERESTLFMVLLAAYTVLLSKYSGQEDLVVGTPVAGRTNADLEPVIGMFVNTLAIRNRPSGDKTFLSYLEEVKETALGAFENQDYPFEELVERLNVKREPGRFPLFDAVFDLQNIEERDAELEGVSLKTYELDHLEEAKFDLTLFMYENNGALSGGFFYATKLFKEAMIRTLTEDYLRVLSQIAENPQLELSRIECHKPAAGAKSAVDTIEFAF

SEQ ID NO: 14 - protein, 1102 aa, Paenibacillus polymyxa F4
MKSLFEKEERYWSGKFDADDSLSFLPYSQSSKLSADGEAAAEPGLLHRTLPSELSERIICLANGSDLALYMIVLAGVKSLLFKYTGRDQVLVGMPSYSADPDGTPPPHDILVIKTSVSRQTTLKTLLGGIKASIGEALEHQHLPFRKMVEPLHLDYTGDGLPVVNTVVSFAPIHPEPLGNRVAADTVFRFDRQNHSIELEISFDGQRYERAFVEQAADHLVRLLSVLLFQPDLELGQADVLSPDERETLLKRFNDTETEFERGKTIYGLFEEQAELYPDNVAAVMNERQLTYRELNERSNRLARKLRETGVEADQLVAILAERSLDMVVGILAILKAGGAYVPVDPDYPEERIRFMIEDSGAPLLLIQKHLHEKTDFAGTRLELDDFVWGDRGADSADVRDASNLEPISGPGNLAYVIYTSGTTGRPKGTLIEHKNVVRLLFNDKNLFDFGPSDTWTLFHSFCFDFSVWEMYGALLYGGKLVIVPPLTAKNPADFLALLGREQVTILNQTPTYFYQLLRKVLADHPYDLRIRNVIFGGEALSPLLLKGFKTKYPETKLINMYGITETTVHVTYKEITWVEMEAAKSNIGKPIPTLSVYVLDENRSPVPIGVAGEMYVAGEGLARGYLNRPDLTAEKFVDSPFAEGEKLYRSGDLAAWLPDGNIEYLGRIDHQVKIRGYRIELDEIETQLLKIAAVQEAKVLDRDDANGHKQLVAYYVAETRLAAHELKEELAKQLPGYMIPSHLVQLSRMPLTPNGKIDRKALPAPEEAAAGGAEYVAPRTLLEMKIARVWQDTLGVPQVGVKDNFFELGGNSLSLMRLVQAVYDETDIEIPLNRQFHNLTVEAMAFGEGDLGLDKGGDSFIKLNKAGDLNVFCFPPGSGFGIGYRELASRLDGRFVLYGIDFIDDAVDYEAMLNRYVDEIVRIQPEGPYVLLGYCFGGNLTFEVAKTMEKRGYSVTDVLMLDSWIKDTLTPSETSEKELEETLADFDEEEKELMSNPLVRERVHRKVKATLAYEAQLINSGTIPARIYELIAKDSEAFRLEHQLPSWRGATTQAYADYRLEGAHEELLELARVEETAVVIRDILEQVKRRIEAEAGVLHGS

SEQ ID NO: 15 - protein, 6282 aa, Paenibacillus polymyxa F4
  misc_feature (2906)..(2906): Xaa can be any naturally occurring amino acid
  misc_feature (3136)..(3136): Xaa can be any naturally occurring amino acid
MRENTNEQYGLTQAQRRIWFMEIMNPGTSITMLSATYQITGEINTQLLEQAAAEIVKTYDVFRIRISGDLQNPTQWFEEPENVQARISRLEIGTTEQFYAWVKEVSEKPASVFDEHLYQFTIIHFANGQVWLNLTVNHIIADGLSVNALLHAVMEKYLELRKGISSSYQAPSYLDYISAEREYEQSQRYQKGKEYWLTKYNTLPETTGIKSYPPFSIGSESNKLAITLDGSRYERILAFSEQYQVSLYTLFLSAMYALLYKLTDSTDVPVGTVFANRTSKKEKETIGMFVSTVATRIRLNPDRHVLSLIQTVSKENTADLRYQKYPYNQLIQDLREQHGRNDLSGLFRTSLEYLPLKIVEYEEIKVRLEAHFARHEMDDLLLRFDHMLNEGHVILHASYRTGLFETAEIDRIMEQYVTVLDQFLQTPELPVREISLLSDEERHRILNVFNPPVAGLSEGEAFHRYVEKFALEIPDHPAVVYMDKQLTYGELNERAERLASLLREQGVGRETITGIWAERSVELLVGVLAVWKAGGAYVPLDPDYPAERIEYMLSDSEATVLLTQRHLLERAGVWLADDRLKLQAVYAMDDEQIYNGDALAVEFESAGSAPQDLAYVIYTSGTTGRPKGVMIEHGSLVNTADAYRREYRLDQFPVRLLQLASFSFDVFVGDIARTLYNGGTMVIVPKDDRIDPNLLYGWIRDQNITVFESTPALILPFMQHIYEEGLDVSSIQLLITSSDACSVTDYRLLLERFGGQFRIINSYGVTEAAIDSSFYGEPLDKLPPSGHVPIGKAWLNARFYIVDAALKPVPVGVPGELVIGGAGVARGYWNRLDLTAEKFVDSPFVPGERVYRTGDLARWLEDGNVDFIGRIDYQVKIRGFRIELGEIETALLRFPGVKQAVVTDRTDEQGQKYLCGYVAADASLQLSDLLSQLKQELPAHMVPARLVSLDKLPLTPNGKIDRKALPEPTGEVETGGEYVAPRTTLETRLALIWQQVLGIARVGVQDDFFDLGGHSLRASTLVSKIRKELQVEVPLREVFRYTTIEQLAQRIGGLRQQETYEITKAAEAEYYPVSSEQKRLYVLRQLDGAERSYNMSAALLLEGKLDRTRVEHAFRALIQRHETLRTGIEQVQGELVQRIYDEVEFAVDYFQASEWEVDQVVEAYYHPFDLTKPPLLRIGLIEVDEDRHILLFDMHHIVSDGISTALLFDEFSRLYRGEELAPLRIQYKDYAVWQHSEAYGQMLQPQKEYWLKQLSGELPVLELPTDFPRPAVQSFDGRTVKFYIEKDRTEKLKELAARTGTTLYMVLLSAYTILMHKYSGQEDLIVGTPIAGRTQEEVQPIVGMFINTLAIRSRPERSKPYLSYLEEIKDITLGAFEHQNYLFEDLVESLHIPRATGRNPLFDTFFSLQNTENEQIVIEGLEQSFYPLENQTSKFELLLDISELDGQLECRLEYATALYKQETAERFARHYDKLLETIAAAPDGDIASLEMLTEEEIRELVRGFNDSEADYPRQQTIHGLFEEQAELYPDNVAAVMNERQLTYRELNERSNRLARKLRETGVEADQLVAILAERSLDMVVGILAILKAGGAYVPVDPDYPEERIRFMIEDSGAPLLLIQKHLHEKTDFAGTRLELDDFVGGDRGANSADVRDASNLEPISGPGNLAYVIYTSGTTGRPKGTLIEHKNVVRLLFNDKNLFDFGPSDTWTLFHSFCFDFSVWEMYGALLYGGKLVIVPPLTAKSPADFLALLGREQVTILNQTPTYFYQLLREVLTDHPYDLRIRNVIFGGEALSPLLLKGFKTKYPETKLINMYGITETTVHVTYKEITWVEMEAAKSNIGKPIPTLSVYVLDENRRPVPIGVAGEMYVAGEGLARGYLNRPDLTAEKFVDSPFAEGEKLYRSGDLAAWLPDGNIEYLGRIDHQVKIRGYRIELDEIETQLLNVEGVEEAVVLARQDGGGEKALVAYFVADRTLTVSEMRTSLAQGMPGYMIPSYFLQLERMPLTSNGKVDRKALPEPQGGLQTGVEYVAPRNRTESQLVKIWEEVLGYSGIGVLDNFFELGGHSLRATNLVSKIRKEMNVELPLRDVFRYTTVESMAGAIASLEETQHSSIPKAEEKAYYPVSSAQKRLYVLHQLDSSELNYNLPSALQLEGALNEAKVEKALTTLVARHDMLRTGFEIVNGEPVQRIHPLVAFKVEKLQASEDQVAAILEGFIQPFDLTQPPLLRALLIELEKEKFLLALDIHHIGSDGLSMDVLLREFVRLYNGEELPELRIQYKDYAVWQQSEEQRQRIKRQEEYWRGVFSSELPVLELPLDFSRPAVQQFDGQTLTFTLDAEKSEALKRLAGDSGATLYMLLLAAYSVLLHKYAGQEDIVVGTPIAARSHADLQPIIGMFVNTLALRLGPVAERTFLDYLQEVKETTLGAYEHQDYPFEELVEALQVSRDLSRNPLFDTMFSLQKHESLDLTLEGLQWSLFDIEEKTAKFDLSFDIVEADNELICKIEYATSLFRQETMVRLAGHYEQLLASILAQPGARISDLDILTDSEKHDLLVGFDVSSSALAKQPAAEGTGLEADESWRERTFHELFEEQAERTPGALAVVYEDSKLTYAELNAKANRLAYALRARGVKPEQVVGILAGRSAELLIGVLAVWKAGGAYVPLDPDYPAERIEYMLADSGASVLLTQTRLLEQAEAWRSDGALVLQTVLALDDAATYSLGAAEAAVGEAGAEAEALAQAAAAESSATAEAEKNVLAADLASNPANVNKPRDLAYVIYTSGTTGRPKGVAVENRSLVNTAAGYRREYRLDQFPVRLLQLASFSFDVFVGDIARTLYNGGTMVIVPKDDRIDPTRLYGWIRDYAVTVFESTPALIVPFMEHVHAEGLDLSSMQLLITSSDACSVADYRTLXERFGSQFRIINSYGVTEAAIDSSFYDEPLEKLPKTGSVPIGKAWLNAKFYIVDANLKPVPIGVLGELVIGGAGVARGYLNRPDLTAEKFVDSPFAAGERLYRTGDLARWMPDGNVDFIGRIDNQVKIRGYRIELGEIEAAMKNFAGVRQALVIDRTDERGQKYLCGYVVADSSFDLEGLVAHLDAALPSHMVPSRIMRLDQMPLTPNGKIDRKALPVPEGSIRAEAAYTXPRTPAEQALASVWQSVLGVDQVGTMDNFFALGGDSIKALQVSSRLLQTGYKLVMKDLFHYPTISALSLQLQTAERTASQAEVTGEVILTPIQRWFFEQNPADVHHSNQAFMQFSKQGFDEEALRQAVRQLVVHHDALRTVYRQTENGYTAWNRGAGENEALFDLEVVDFKGVGDVKEAVEAKANDIQASIDLENGPLVKLGLFRCDDGDHLLIAIHHLVVDGVSWRILLEDFAACYEQALQGQPIRLPLKTDSFQTWAKQLADYANGPAMESEREYWQHIEQLTYEPLPKDFEQGRSKLKDSGLVTVRWTAEETEQLLKQAHCAYHTEMNDLLLAALGLAVQAWSGRERVLVNLEGHGREDILPNVDITRTVGWFTSQFPVVLEPGHAQALGHQVKQVKESLRRIPNKGIGYGILRYLSAPRDGERFALEPEISFNYLGQFDQDYESSGSRPSPFSPGSDSSPDAVMDYVLDINGMVSEGVQELTIRYGETQYKRETVERLGTLLHSSLREVISHCVSKERPELTPSDVLLQDVTLEELERLAEHTAALGELENVYTLTPLQKGMLFHSLLDADSEAYFEQVTFDLYGSLNVEAFTQGLDTLVQRNEALRTNFITGWRDEPIQVVFRERKCEVYFEDIRSVSDEDPEKTIADFVSADKANKFDLARGSLMRVTVLRTGDESYHVIWSHHHILMDGWCMSFMIKEVFDTYFAFQEKRTLELPPVTSYSRYIEWLEAQDAAKASRYWSEYLAGYDQQTKLPQEKTQLKQGAFEAAEIDVELSKELTGQIERVARQQQVTLNTFMQTVWGLVLQVYNNSEDVVFGSVVSGRPAEIPGIESMIGLFINTIPVRIQGKAEETVADILRKTQDQALASGAYETFPLFEIQSLSEHKRDLINHIMVFENYPMEEQIEQVVGGDKEALKIANIQSPEQTNYDLDITVIPEEHILLRFTYNALTFREEDIRLIHGHFARVLEKVAANPSIRVNQLELLTAAEKEQILGAFNPAQPEAAPAAAFHRLFEEQAERTPEAAAVVYENDRLTYEELNERANRLAATLRASGIGRETIVGILAERSVDLLVAVLAVWKAGGAYVPLDPDYPAERVRFMLEDSGAKVLLTQTPLRERAEAWLGEEELALAAVLYLDDETSYSEERTNADSFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHDQRLDMSWMELLITSSDSCSVADYRTLQERFGSLFRIINAYGVTEAAIDSSFYDEELAKLPQTGNVPIGKAWLNAKFYIVDAHLNPVPVGVLGELVIGGVGVARGYLNRPELTEEKFVDSPFAAGERLYRTGDLARWMEDGNVDFIGRIDNQAKIRGYRIETGEVEAKLLSVGGVKEAVVVVREDQEGQKALCAYYTAEEGLTAADLKRAIANELPGYMIPSYFVELEHLPLTPNGKIDRKALPAPEGGASAGREYVAPRTELEAKLAAIWQDVLVREKAVGVTDNFFDLGGHSLRATTLVSKMHKELGVEFPLRDVFRYSTVEEMAAAMERLEIGSFTAIPAAEPSEYYPLSSAQKRLYILNQLEGAELSYNIPGAMLLEGELDRQRFEEAFRGLVARHETLRTGFEMVKGEAVQRIYEEAAFQVEYVQISAEQAEETVRQFVRPFDLAKPPLLRVGLAELAPDRHILMFDTHHIVSDGVSIDVLIEEFVRLYSGEQLEPLRIQYKDYAVWQQSDEQKAQLAKQEAYWLDMFRGELPVLELPMDYPRPAMQSYEGRTLQLFMHSEKSEGLKRLAAENGATLYMVLLAGYTILLHKYTGQEDVVVGTPIAGRNHSDVQPLIGMFVNTLAIRSYPAAGKTFLDYLKEIKETTLGAFEHQNYPFEELVDKVNVARDLSRNPLFDTMFALQNTENLEIQLPGLHLSTYASEEIVSKFDLSLDVTEIEEGLEYLFEYATALYKTETVEKLAAHYLQLLESILRNPSATIAELGILTPAEKEQILGAFNPAQPGAAPAAAFHRLFEEQAERTPEEAAVVYENDRLTYAELNERANRLAATLRASGIGRETIVGILAERSVDLLVAVLAVWKAGGAYVPLDPDYPADRVRFMLEDSGAKVLLTQTPLRERAEAWLDEEELALAAVLYLDDEASYSEERANASVVSGIVSGIVSGKLTDAVDDGDESHQNVGTDSFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHEQQLDMSWMELLITSSDSCSVADYRTLQERFGSLFRIINAYGVTEAAIDSSFYDEELAKLPQTGNVPIGKAWLNAKFYIVDAHLNPVPVGVLGELAIGGVGVARGYLNRPELTEEKFVDSPFAAGERLYRTGDLARWMEDGNVDFIGRIDNQAKIRGYRIETGEVEAKLLSVGGVKEAVVVVREDQEGQKALCAYYTAEEGLTAADLKRAIASELPGYMIPSYFVELERLPLTPNGKIDRKALPAPEGGASAGREYVAPRTELEAKLVAIWQDVLGPVTIGVTDNFFDLGGHSLRATTLVSKVHKELSVDLPLRDVFRHSTIEAMAEAISQLERQEHLSIPVLDKRDYYPLSSVQKRLYIQQQMEGAELSYNMSGMTVLVGRLERNQFEAALKGLIARHEILRTGFEMVDGEPVQRIYPDLKFAVEYTKATESETKSIVDGFVRVFDLERPPLLRVGLVEWEAERHLLMLDIHHIVTDGMSMGIFVEELLRLYNGETMEPLRIQYKEFAAWQQSEPVKERLKRQEAYWLDVLEGELPTLELPTDFVRPAARSFEGDVLPFSIDKQMTDSLQRIADENGATLYMVLLAAYSILLSKYSGQEDFIVGTPVSGRTHADLEPLIGMFVNTLAIRHYPSGEKTFLAYLNEVKETMLGAYDHQDYPFEELVKKLQAPRDQGRNPVFDVMFALETKEDNVQSFGDIKIESYPETHTVSQFDLTLVISLLDEGMNGQFEYATKLFTRNLIDNFAQDLLVIITQICEQPSVLLKDISLNGQSEQEQDVLETIDIIF

SEQ ID NO: 16 - protein, 4966 aa, Paenibacillus polymyxa ATCC21830
MAFEKETLFWNEKFGSDDYTLTRLPYSKAPSSLTPIMTTVGGTLSEEVAQRVLQMSKGAPLATFMILLAGVQSLLYKYTGASDILVGMPVVRKPTETRRSVNHTIILKNSLSAGATFKTLLSELRTSLPEAIQHQHIPFLKMTEKLDLQYADGIPVVHTLVSLKELHLDEIGQNVVTDCSFEFSLTGGTIQLALSYNEHLYDSEFMTRVVGHLNRLLAVGLHELELEIVRADMLSEDEKFQLLQSFNDTEKDYPRDRTIHQLVEEQAKRVPEATAVVFEGRRLSYAELNERANRLARTLRSVGVLPNQLVGLMARRSLETVVGILAVLKAGGAYVPIDPEYPEERIRYILENSNAQLLLTQRELLQQVPFEGTVLALDDEQTYSDDGSNLEPASGPNDLAYVIYTSGTTGKPKGVMLEHRGLVSLKLMFADRLGITEHDRIVQFASLSFDASCWEMFKALYFGAALYIPTAETILDTRLFESYMNEHAITAAILPPTYSAYLNPDRLPSLTKLVTGGSAVSAEFVQQWKPKVHYFNAYGPTEASIVTTLWDADEEQSERRVIPIGRPLANHRIFILDAHLQLVPPGVDGELCVAGVGLARGYLNHPELTAEKFVEHPFAPGERLYRTGDLARWLPDGNIEYLGRIDHQVKIRGFRIEIGEIEEQLLKIDSVQETIVIAREGKSGQELCAYLVAGHPLTLGELRSALAQKLPNYMIPAHFVQLPRMPLTPNDKIDRKALPVPEGNALTGGAYVAPRNEAERTLADVWQAVLNADRVGVTDHFFELGGDSIKSIQVSSRLHQAGYKLEIRDLFKYPTISQLSLHVKPIGRTIDQGEITGETALTPIQHWFFESSFADPHHFNQSVILYRKERFDEETVRQVLQKLAEHHDALRMVFRKTEQGFSARNRAIQEGGLFTLDVFDFKDAKNTAQAVEAKATDIQAGIDLENGPLVKAGLFRCADGDHLLLAVHHAVVDGVSWRILMEDFALGYEQAGKSEEIRFPAKTDAYRTWSEQLAAYVQSPEMAKERAYWQAVEQIAVPAVPKDLEADVTTQQDSESLFVCLTPEETELLLKRVHRAYNTEMNDILVTALGIAIRKWTGHERVRINLEGHGRESIGTDIDITRTVGWFTTKFPVVLEPETDRDLAYQIKQVKESLRRIPNKGLGYGVCRYLSKSEDGFVWGAEPEINFNYLGQFDDDVNQDEIGISSYSSGSPASDRQARSFVLDINGMVLDGALSLDLSYSRKQYRKETIEAFAQRLEQSLRELITHCAGKENTELTPSDVQFKGLTIAELEQIAQRSGHLGEIENIYSLTPMQKGMWFHSALDRQTAAYFEQTRFTMRGALDVQLFERSWMELAKRHLVLRANFVKGPAGEPLQIIYRDKPVGFEYEELLHLQADEKQTYLDKKAEDDKLRGFDLEHDALVRVTILRTEEQSYHVLWSFQHILMDGWCLPQLTQELFETYSALASGKQPAGDKGSDYGAYIEWLEKQDDQAASGYWTAFLAGYEGQTVLPGQKEPAPNGRFTADHVTAELGKDLSERMDRVAKQRLVTVNTLLQAAWGVMLQKYNGTNDAVFGSVVAGRPAEIPGIESMIGLFINTVPVRVTSEADTVFADLMAKLQERALESGRYDYYPLYEIQAHSVQKQNLINHIIAFENYPVDEQMEQAGDQQHGDLTIADVQMEEQTNYNFNVTVVPGDEIEIRFDFNAEVFDKDSIERLKGHLVHLLEQVTDNPEITVGELELVTEAEKADLLGRFNDTTTEFPRGKTLIQLFEEQAERIPDAAAISLNEQELTYRELNERVNRLARTLRSHGISKGRLVAIMAERSIEMVVGMLAAHKAGAAYVPIDPEYPEERIRFLIEDSGAQVMLTQSRLRERLAGSDSVILLDDESFYHEDGTNLNPGTEATDLACVIYTSGTTGKPKGNLVSHRNIVRIVRNTNYIDITERDHVLQLSSYSFDGAIFDVFGALTNGARLVLVPRETLLEIGRLADLIQHERISVMLITTAYFNVLVDVNVDCLRDVRAILFGGERVSVGHVRRALAHIGPGRLNHLYGPSESTVYTTYLPVDFVDESAVTVPIGRPISNTTVYIVDSRNKLLPIGVAGELCVGGEGLVRGYNNRPELTAEKFVDNPFVPGERMYRTGDLAKWLPDGTIEYVGRTDDQVKIRGFRIELGEIEAQLQKVEGIRKTTVFARENASGEKQLCAYYEADRELSAAELKNVISQELPAYMIPAYLIQLERLPLTANGKVDRRSLPTPEESLQPGEGRTPPRTPLEASLAGIWKSVLALEHIGVHDNFFDLGGHSLRATTLVSKVHQELNVELPLRDVFRYSTIEEMALAITRIGEQSFSSIPLAGVREYYPLSSAQKRLFILNQLEGSDQSYNMPGVLLLEGSIDRSLLEKAFRGLIVRHETLRTGFEIVQGEAVQRIYESVDFAVEYRHASEEEAPEVVQAFIRPFDLAKPPLLRVELVELATERYLLMFDMHHIVSDGVSMDVLVEELVRLYGGESLEPLRIQYKDYAVWQQSDEQKAQLKREEAYWLDRYRGELPVLEMPTDYPRPAVQSFEGQTLTSFVDEATNEGLKQLAAQRGTTLYMVLLAAYTVLLHKYTGQDDLIVGTSIAGRTHGDTQPLIGMFVNTLALRNYPASEKTFLSYLEEVKETTLGAYEHQNYPFEELVDKVQVSRDLSRNPLFDTMFSLQNLEDKEFELEGLKLSPYPSEYGTAKFDLSVDVTEENGGLECSFEFATALYKESTIRRLSTHFGHLLAEIVSCPDAKIAELNLLTAEEKEQILGAFNPAQPEVAPAAAFHRLFEEQAERTPEAAAVVYENDRLTYAELNERANRLAATLRASGIGRETIVGILAERSVDLLVAVLAVWKAGGAYVPLDPDYPAERVRFMLEDSGAKVLLTQTALRERAEAWLGEEELALAAVLYLDDEASYSEERANAPIVFGISSKLTDAVDDGDESPQNVGTDSFHEARPEDLAYVIYTSGTTGKPKGVMIEHRSLVNTAAGYRQEYRLDQFPVRLLQLASFSFDVFVGDIARTLYNGGTMVIVPKDDRIDPSRLHHWIEQERVTIFESTPALIVPFLEYVHEHRLDMSWMELLITSSDSCSVADYRTLQERFGSLFRIVNAYGVTEAAIDSSFYDEPLAKLPQTGHVPIGKAWLNAKFYIVDAHLNPVPVGVLGELVIGGVGVARGYLNRPELTEEKFVDSPFAAGERLYRTGDLARWMEDGNVDFIGRIDNQAKIRGYRIETGEIESQLLRVKGVREAVVLVLSDANGQKALCAYYTPDTGAELAVNDLRSTLAQELPGYMIPSYFVELEHLPLTPNGKIDRKALPAPEGEAGNGTEYVAPRNELETKLAAIWQEVLGLAKEIGVHDNFFDIGGHSLRATTLVSKIHKELNVDLPLRDVFRHSTIESMAAAISRLDEQTFVSIPVADDREVYPQSFAQKRLFILNQLEGAELSYNMPEAMLLEGALDRARFEEAFRKLVTRHETLRTGFEMVDGEASQRIYQDVNVAVEFYRADKQEAEETVRRFVRPFDLAKPPLLRVGLVELAPERHILMYDMHHIISDGVSMEIFVEEFVRLYGGEQLDPLRIQYKDYTVWQHSQEQKERLQRQEAYWLDMFQGELPVLEMPTDYPRPAVQSYEGQTLEFFFDASKTDGLKQLASETGTTLFMVLLAAYNVLLHKYSGQEDVIVGTPIAGRNHGDVQPLIGIFLNTLAIRSYPASEKTFLSYLNEVKETTLHAFEHQNYPFEELVDKVQVTRDLSRNPLFDTLFTMQNTENEEFELEGLRLIPYPSALDTAKFDISLDVGEENGGLDYSFEYATALYKRETIERLAKHYEQLLVTIVSRPDAKIAELNLLTAEEKEQILGAFNPAQPEATSAAAFHRLFEEQAERTPETAAVVYENDRLTYAELNERANRLAATLRTSGIGRETIVGILAERSVDLLVAVLAVWKAGGAYVPLDPDYPAERVRFMLEDSGAKVLLTQTALRERAEAWLGEEELALAAVLYLDDETSYSEERANAPIVSGMVSGKLTDAVDDGDESHQNVGTDSFHEARPEDLAYVIYTSGTTGKPKGVMIEHRSLVNTAAGYRRKYRLDQFPVRLLQLASFSFDVFVGDIARTLYNGGTMVIVPKDDRIDPSRLHHWIEQERVTIFESTPALIVPFLEYVHEHRLDMSWMELLITNSDSCSVADYRTLQERFGSLFRIVNAYGVTEAAIDSSFYDEELAKLPQTGNVPIGKAWLNAKFYIVDAHLNPVPVGVLGELVIGGIGVARGYLNRPELTEEKFVDSPFAAGERLYRTGDLARWMEDGNVDFIGRIDNQAKIRGYRIETGEIESQLLRVEGVREAVVLVRSDANGQKALCAYYTLDTGAELAVNDLRSALAQELPGYMIPSYFVELGRLPLTPNGKIDRKALPAPEGEAGSGTEYVAPRNELETKLAAIWQEVLGLAKEIGVHDNFFDIGGHSLRATTLAGKVFKELNVNLPLRDVFRHSTIAAMAEAIARMERREHEAIPQAEEREYYPLSSAQKRLFIQHTLDGADQLYNMPELVQVEGEFDLDRLEAALRKLITRHESLRTGFEIVKGEAVQRVYPQVDFAIEHHQADKEDAAQIEQIVRSFIRPFDLGKPPLLRAGVIELEPNLHILLFDMHHMVSDGVSMAIVIDEFSSFYAGEELPPLRIQYKDYAVWQQSKAHRERIGRQEAYWLQTFEGELPTADLPIDYERSAARSYEGAHLEFNVEASLSARLRELAAERESTLFMVLLAAYTVLLSKYSGQEDLIVGTPVAGRTNADLESVIGMFVNTLAIRNRPSGDKTFLSYLEEVKETALGAFENQDYPFEELVERLNVKREPGRFPLFDAVFDLQNIEERDAELEGVSLKTYELDHLEEAKFDLTLFMYENNGALSGGFFYATKLFKEAMIRTLTEDYLRVLSQIAENPQLELSRIECHKPAAGAKSAVDTIEFAF

SEQ ID NO: 17 - protein, 1102 aa, Paenibacillus polymyxa ATCC21830
MKSLFEKEERYWSGKFDADDSLSFLPYSQSSKLSADGEAAAEPGLLHRTLPSEISERIICLANGSDLALYMIVLAGVKSLLFKYTGRDQVLVGMPSYSADPDGTPPPHDILVIKTSVSRETTLRTLLGGIKASIGEALEHQHLPFRKMVEPLHLDYTGDGLPVVNTVASFAPIHPEPLGNRVAADTVFRFDRQNHSIELEISFDGQRYERAFVEQAADHLVQLLSVLLFQPDLELGQADVLSPDERETLLKRFNDTETGFERGKTIYGLFEEQAELYPDNVAAVMNERQLTYRELNERSNRLARKLRETGVEADQLVAILAERSLDMVVGILAILKAGGAYVPVDPDYPEERIRFMIEDSGAPLLLIQKHLHEKTDFAGTRLELDDFVWGDRGADSEGALDASNLEPISGPVNLAYVIYTSGTTGRPKGTLIEHKNVVRLLFNDKNLFDFGPSDTWTLFHSFCFDFSVWEMYGALLNGGKLVIVPPLTAKNPADFLALLGREQVTILNQTPTYFYQLLRKVLADHPYDLRIRNVIFGGEALSPLLLKGFKTKYPETKLINMYGITETTVHVTYKEITWVEMEAAKSNIGKPIPTLRVYVLDENRRPVPIGVAGEMYVAGAGLARGYLNRPDLTAEKFVDSPFAEGEKLYRSGDLAAWLPDGNIEYLGRIDHQVKIRGYRIELDEIETQLLKIAAVQEAKVLDRDDANGQKQLVAYYVAETRLAVHELKEELAKQLPGYMIPSHLVQLPRMPLTPNGKIDRKALPAPEEAAARGAEYVAPRTLLEMKIARVWQDTLGVPQVGVKDNFFELGGNSLSLMRLVQAVYDETGIEIPLNRQFHNVTVEAMAFGEGDLGLDKGGDSFIKLNKVGNLNVFCFPPGSGFGIGYRELASRLDGRSVLYSIDFIDDAVDYEAMLNRYVDEIVRIQPEGPYVLLGYCFGGNLTFEVAKTMEKRGYSVTDVLMVDSWIKHTLTPSETSEKELEETLADFDEEEKELMSNPLVRERVHRKVKATLAYEAQLINSGTIPARIYELIAKDSEAFRLEHQLPSWRGATTQAYADYRLEGAHEELLELARVDETAVVIRDILEQVKRQIEAEAGVLHGS

SEQ ID NO: 18 - protein, 5789 aa, Paenibacillus polymyxa ATCC21830
MREDTNEQYGLTQAQRRIWFMEIMNPGTSITMLSATYQITGEINTQLLKQAAAEIVKTYDVFRIRISGDLQNPTQWFEEPENVQARISRLEIGTTEQFYAWVKEVSEKPASVFDEHLYQFTIIHFANGQVWLNLTVNHIIADGLSVNALLHAVMEKYLELRKGISSSYQPPSYLDYISSEREYEQSQRYQKGKEYWLTKYNTLPETTGIKSYPPFSIGSESNKLSITLDGSRYERILAFCEQYQVSLYTLFLSAMYALLYKLTDSTDVPVGTVFANRTSKKEKETIGMFVSTVATRICLNPDGHVLSLIQTVSKENTADLRYQKYPYNQLIQDLREQHGRNDLSGLFRTSLEYLPLKIVEYEEIKVRLEAHFARHEMDDLLLRFDHMLNESHVILHASYRTGLFEKAEIDRIMEQYVTVLDQFLQTPELPVREISLLSDDEKHRILNVFNPPVAGLSEGEAFHRYVEKFAREIPDHPAVVYMDKQLTYSELNERAERLASLLREQGVGRETITGIWAERSVELLVGVLAVWKAGGAYVPLDPDYPAERIEYMLSDSDASVLLTQRHLLERAGGWLADDRLKLQAVYAMDDEQIYNGDALAVEFESADSAPQDLAYVIYTSGTTGRPKGVMIEHGSLVNTADAYRREYRLDQFPVRLLQLASFSFDVFVGDIARTLYNGGTMVIVPKDDRIDPNLLYGWIRDQNITVFESTPALILPFMQHIYEEGLDVSSMQLLITSSDACSVTDYRLLQERFGGQFRIINSYGVTEAAIDSSFYGEPLDKLPPSGHVPIGKAWLNARFYIVDAALKPVPVGVPGELVIGGAGVARGYWNRPDLTAEKFADSPFVPGERLYRTGDLARWLEDGNVDFIGRIDYQVKIRGFRIELGEIETALLRFPGVKQAVVTDRTDEQGQKYLCGYVVEDASVQLSDLLSQLKQELPAHMVPARLVSLDKLPLTPNGKIDRKALPEPTGEVEAGHEYVAPRTTLETRLALIWQQVLGIARVGVQDDFFDLGGHSLRASTLVSKIRKELQVEVPLREVFRYTTIEQLAQRIGGLRQQETYEITKAAEAEYYPVSSEQKRLYVLRQLDGAERSYNMSAALLLEGKLDRTRVEHAFRALIQRHETLRTGIEQVQGELVQRIYDELDFAVDYFQASEREVEQVVEAYYHPFDLTKPPLLRIGLIEVAEDRHILLFDMHHIVSDGISTALLFDEFSRLYRGEELAPLRIQYKDYAVWQHSEAYGQMLQPQKEYWLEQLSGELPVLELPTDFPRPAVQSFDGRTVKFYIEKDRTEKLKELAARTGTTLYMVLLSAYTILMHKYSGQEDLIVGTPIAGRTQEEVQPIVGMFINTLAIRSRPERSKPYLSYLEEIKDITLGAFEHQNYLFEDLVESLHIPRATGRNPLFDTFFSLQNTENEQIVIEGLEQSFYPLENQTSKFELLLDISELDGQLECRLEYATALYKQETAERFARHYDKLLETIAAAPDGDIASLEMLTEEEIRELMRGFNDSEADYPRQQTIHGLFEEQAELYPDNVAAVMNERQLTYRELNERSNRLARKLRETGVEADQLVAILAERSLDMVVGILAILKAGGAYVPVDPDYPEECIRFMIEDSGAPLLLIQKHLHEKTDFVGTRLELDDFVWGDRGADSEGALDASNLEPISGPLNLAYVIYTSGTTGRPKGTLIEHKNVVRLLFNDKNLFDFGPSDTWTLFHSFCFDFSVWEMYGALLYGGKLVIVPPFTAKNPADFLALLGREQVTILNQTPTYFYQLLREVLTDHPYDLRIRNVIFGGEALSPLLLKGFKTKYPETKLINMYGITETTVHVTYKEITWVEMEAAKSNIGKPIPTLRVYVLDENRRPVPIGVAGEMYVAGEGLARGYLNRPDLTAEKFVDSPFAEGEKLYRSGDLAAWLPDGNIEYLGRIDHQVKIRGYRIELDEIETQLLNVEGVEEAVVLARQDGGGEKALVAYFVADRTLTVSEMRTSLAQGMPGYMIPSYFVQLERMPLTANGKVDRKALPEPQGSLQTGVEYVAPRNRMESQLVKIWEEVLGYSGIGVLDNFFELGGHSLRATNLVSKIQKEMNVELPLRDVFRYTTVESMAGAIASLEETRHNSIPKAEEKAYYPVSSAQKRLYVLHQLDGSELNYNLPSALQLEGALNEAKVEKALTTLVARHDMLRTGFEIVNGEPVQRIHPIVAFKVEKLQASEDQVAAILEGFIQPFDLTQPPLLRALLIELEKEKFLLALDIHHIGSDGLSMDVLLREFVRLYNGEELPELRIQYKDYAVWQQSEEQRQRIKRQEEYWRGVFSSELPVLELPLDFSRPAVQQFDGQTLTFTLDAEKSEALKRLAGDSGATLYMLLLAAYSVLLHKYAGQEDIVVGTPIAARSHADLQPIIGMFVNTLALRLGPAAERTFLDYLQEVKETTLGAYEHQDYPFEELVEALQVSRDLSRNPLFDTMFSLQKHESLDLTLEGLQWSLFDIEEKTAKFDLSFDIVEADNELVCKIEYATSLFRQETVVRLAGHYEQLLTSILAQPGARISDLDVLTDSEKHDLLVGFDVSSSALAKQPAAEGTGLEADESWRERTFHELFEEQAERTPEALAVVYEDSKLTYAELNAKANRLAYALRARGVKPEQVVGILADRSAELLIGVLAVWKAGGAYVPLDPDYPAERIEYMLADSGASVLLTQTRLLEQAEAWRSDGALVLQTVLALDDVATYSLGAAEAAVGVQALGEAGAEAEALAQAAAAETSATAEAEKNVLAADLASNPANVNKPRDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHEQRLDMSGMELLITSSDSCSVADYRTLQERFGSQFRIINSYGVTEAAIDSSFYDEPLEKLPKTGSVPIGKAWLNAKFYIVDANLKPVPIGVLGELVIGGVGVARGYLNRPDLTAEKFVDSPFATGERLYRTGDLARWMSDGNVDFIGRIDNQVKIRGYRIETGEVEAKLLSVGGVKEAVVVVREDQEGQKALCAYYTAEEGLTAADLKRAIASELPGYMIPSYFVELERLPLTPNGKIDRKALPAPEGGAGGREYVAPRTELEAKLAAIWQDVLVREKAVGVTDNFFDLGGHSLRATTLVSKMHKELGVEFPLRDVFRYSTVEEMAAAMERLEIGSFTAIPAAESSEYYPLSSAQKRLYILNQLEGAELSYNIPGAMLLEGELDRPRFEEAFRGLVARHETLRTGFEMVKGEAVQRIYEEAAFQVEYVQISEEQAEETVRQFVRPFDLAKPPLLRVGLAELAPDRHILMFDTHHIVSDGVSIDVLIEELVRLYSGEQLEPLRIQYKDYAVWQQSDEQKAQLAKQEAYWLDMFRGELPVLELPTDYPRPAMQSYEGRTLQLFMDSEKSEGLKRLAAENGATLYMVLLAGYTILLHKYTGQEDVVVGTPIAGRNHSDVQPLIGMFVNTLAIRSYPAAGKTFLDYLKEIKETTLGAFEHQNYPFEELVDKVNVARDLSRNPLFDTMFALQNTENLEIQLPGLHLSTYASEEIVSKFDLSLDVTEIEEGLEYLFEYATALYKTETVEKLAAHYLQLLESILRNPSATIAELGILTPAEKEQILGAFNPAQPEAAPAAAFHRLFEEQAERTPEAAAVVYESDRLTYAELNERANRLAATVRASGIGRDTIVGILAERSVDLLVAVLAVWKAGGAYVPLDPDYPAERVRFMLEDSGAKVLLTQTLLRERAEAWLGEEELALAAVLYLDDEASYSEERANAPLEADDHLHECRPEDLAYVIYTSGTTGKPKGVMIEHRSLVNTAAGYRREYQLNQFPVRLLQLASFSFDVFVGDIARTLYNGGTMVIVPKDDRINPSRLHYWISQQQVTIFESTPALIVPFLEYVHEHQLDMSGMELLITSSDSCSVADYRTLQERFGSLFRIINAYGVTEAAIDSSFYDEELAKLPQTGNVPIGKAWLNAKFYIVDAHLNPVPVGVLGELVIGGVGVARGYLNRPELTEEKFVDSPFAAGERLYRTGDLARWMEDGNVDFIGRIDNQVKIRGYRIETGEVEAKLLSVGGVKEAVVVVREDQEGQKALCAYYTAEEDLTAADLKRAIASELPGYMIPSYFVELERLPLTPNGKIDRKALPAPEGGAGGGREYVAPRTELEAKLAAIWQDVLVREKAVGVTDNFFDLGGHSLRATTLVSKMHKELGVEFPLRDVFRYSTVEEMATAMERLEIGSFTAIPAAEPSEYYPLSSAQKRLYILNQLEGAELSYNIPGAMLLEGELDRQRFEEAFHGLVARHETLRTGFEMVKGEAVQRIYEEAAFQVEYVQISGEQAEETVRQFVRPFDLAKPPLLRVGLAELAPDRHILMFDTHHIVSDGVSIDVLIEEFVRLYSGEQLEPLRIQYKDYAVWQQSDEQKAQLAKQEAYWLDMFRGELPVLELPTDYPRPAMQSYEGRTLQLFMDSEKSEGLKRLAAENGATLYMVLLAGYTMLLHKYTGQEDVVVGTPIAGRNHSDVQPLIGMFVNTLAIRSYPAAGKTFLDYLKEIKETTLGAFEHQNYPFEELVDKVNVARDLSRNPLFDTMFALQNTENLEIQLPGLHLSTYASEEIVSKFDLSLDVTEIEEGLEYLFEYATALYKTETVEKLAAHYLQLLESILRNPSATIAELGILTPSEKEQILGAFNPAQPEAAPAAAFHRLFEEQAERTPEAAAVVYESDRLTYAELNERANRLAVTLRTSGIGRDTIVGILAERSVDLLVAVLAVWKAGGAYVPLDPDYPAERVRFMLEDSGAKVLLTQTLLRERAEAWLGEEELALAAVLYLDDEASYSEERANAPLEADDHLHECRPEDLAYVIYTSGTTGKPKGVMIEHRSLVNTAAGYRREYQLNQFPVRLLQLASFSFDVFVGDIARTLYNGGTMVIVPKDDRIDPSRLHHWIEQERVTIFESTPALIVPFLEYVHEHRLDMSWMELLITSSDSCSVADYRTLQERFGSLFRIINAYGVTEAAIDSSFYDEELAKLPQTGNVPIGKAWLNAKFYIVDAHLNPVPVGVLGELVIGGVGVARGYLNRPELTEEKFVDSPFAAGERLYRTGDLARWMEDGNVDFIGRIDNQAKIRGYRIETGEIESQLLRVEGVREAVVLVRSDANGQKALCAYYTTDGELTVADLKRAISSELPGYMIPSYFVELERLPLTPNGKIDRKALPAPEGGASAGREYMAPRTELEAKLVAIWQDVLGPVTIGVTDNFFDLGGHSLRATTLVSKVHKELSVDLPLREVFRHSTIEAMAEAISQLERQEHLSIPVLDKRDYYPLSSVQKRLYIQQQMEGAELSYNMSGMTVLVGRLERNQFEAALKGLIARHEILRTGFEMVDGEPVQRIYPNLKFAVEYTKATESETKSIVDGFVRVFDLERPPLLRVGLVEWEAERHLLMLDIHHIVTDGMSMGIFVEELLRLYNGETLEPLRIQYKEFAAWQQSEPVKERLKRQEAYWLDVLEGELPTLELPTDFVRPAARSFEGDVLPFSIDKQMTDSLQRIADKNGATLYMVLLAAYSILLSKYSGQEDFIVGMPVSGRTHADLEPLIGMFVNTLAIRHYPSGEKAFLAYLNEVKETMLGAYDHQDYPFEELVKKLQAPRDQSRNPVFDVMFALETKEDNVQSFGDIKIESYPETHTVSQFDLTLVISLLDEGMNGQFEYATKLFTRNLIDNFAQDLLMIITQICEQPSVLLKDISLNGQSEQEQDVLEAIDIIF

SEQ ID NO: 19 - DNA, 1827 bp, Paenibacillus polymyxa E681
atggaagctgaccggcagccgtctgttcaagaacaaggcgcagcggcgccttccaagcgccaaaccgcttacgccgcctggaaagcgttccgctggctgatgtcctatgtaagccgtcacaaaggctggatgatcgtcggtaccttgtccgcgattgccgccgccgttattgagatatggacgggaagtttgatcgagcagctgaccacccaggccgagaagggggcggggccaatcgttctgcaaatcgtgtacacggtctttgtggtcatcttgatcggtgtgccggcgaagtttttcatgagcttcggcgtggagcgaagcagcgcctctgcggtgcaggatatccgcaaccgtctcatgcgtcatatcggcaaactcccgatctcctatttggaaaagcagcactccggcgacgtattgtcgcggatcaacaacgacctgcagctcatccagcagtttatgattcgggacctcgcccagtggttttatcatccgctgttgttcatcggctgtttcgcttatttgatctacctccaatgggagctgatgctgtacagcttgctgttatttcccgtagcgctgctggtttcccaatggatcggcaagcagttggagcggttgacggaggaagcccaggcgaacatgggccgaatgaacgtcaacctccaggatacgcttgggggtatgcctattgtaaaaagctacctgctatccggcatgttatctcgctcctaccaagcgctgctgcaattgacggctcaaaaaaagctggccgtgaaaaagcgagaagcctgggtcaacccgctgctttccacgctgatgatcagcccgatcattttcgccgtcagttacggaagttatttgatctacaaagggcagctaggcgcgggagaactgatcgccttcctgtacttgctgaatctgtgtctggagccgctggagcatattcccgagctcatcacgcggacgttcgaaatggccggtgccctgagaagggtctccgaaatcgtcgagcagccgaccgaaacggaaaatggccgttcgcttccgaaagcgagcgccgcccccatcgagtttcagaacgtaaccttcgggtatgaggagaaatccccgatcctgcggaatgttagcttctcggtgccggaagggaagacgatcgcgcttgtcggagcgagcggcggagggaagagcacggtgtttaagcttgtatgcggtttttatccgcttccggaggaccagggcgagatccgcgtgttcggcagcctgatccacggcgccgatccggagcagcttcggtcgcatttttccgtggtaacccaggattcatatttgtttagcggcacgatcgctgaaaatatcggctacgggcgggaagtagcgtcgatggacgagattatcgaagccgccaaagccgctcaggcgcattccttcattatgcagcttcccgacggctaccagacgtatgtcggagagcgcggaggctttttgtccggcgggcagcgccagcgcattgcaatggcccgagcttttctgaaggatgcttccgttctgctgctggacgagccaacgtcggctcttgatccggagtcggaaaacgcggttcaggaagccctgggcgtattgatgaagcagagaacgacgatggttattgcccaccggctttctacagtacaaaacgccgacgaaatttgggtcatggaacaggggagtattgttgaaaagggcactcatgaacaattgctgaagatgaagggactgtacgcccagtcgtactatcaggaatttaccgagtctgccgaacgcagggaggtggcgtacacatga

SEQ ID NO: 20 - DNA, 1734 bp, Paenibacillus polymyxa E681
atgaaaaagggcggatggctctcgcaagtgaaagaactcggctacttgctgatgtttatgaaccgcaagcgcaaaacccagtacgccattggcctggccgtgacggcgctcacccagacattgttcctgatcgccttcagcttggtcgtacataacttggttgatttcgctgtgtcccgagatacgtccctgatggtggaagcctttattattttgggcgcggccttgttcctggaaaatgtgatttctccctggttcatttacttataccagcgcagtgtcgagctgactgtgctgaatatccgcgaacgtctttatgacaagctgtgccgggtgcggccgagattcctggagcagacgcaccatggggacttgctgtcgcgagtgaacaacgacgtaacgaccgttgagtttacattctcgcaggtttacttcgttttgctgcttcaagttgtcttttgtatcggctccattgtctccatggtgttgatcgattggcgttttgccggcgtatccttcgtcattctgctgctgtcctccgtggtcagcctgaaatttgcgcgggatattcgcgccttgtccgaacaaggcttgcaaacgctcggtaaaatgaccgaaaaattcaaagattttatgggcggcattcaaattgtgaagctgttccgcatccgcacgatttatggccagtacgaggcgttgaacgaacaaatgacgcagacgcttcggcaaaccgcgcagaagaacggcatgcaggctgcggtgaatcattttatcagctacgtcacgttctgcggcatcatcgtcatcggcagtcttctttatgcccacggactgatgggaatgggaagcgttgccgccctggcggttctgcaagtgaatctgacgcacgccttgttgaacttggggatggttctgtcgatgacccaaaattcgctcgcgggcgctcaccggattcaagaggtactaagagaggaagaggaaccggagcgtttgggatctcctcacagcgagctcgtgtcggaggctgcagtggagtttcgcgatgtggaattttcctatcaggcggataaaaaggtgcttgtcgacatctccatgcaggtgtttcccggccaggtcgccgctatcgtgggggccagcggcagcggcaaaagtacgctgatcaagctgctgctcggcttttatcctgtggacagcggagaaatcctactccaaggcaaaccgttcggccattacacgctggacgaaatccgcaggcagattgcatacgttccgcaggagccgttcttgtttaccggtacgattgaggaaaacatccgctacggcaacccggatgcaacggatgaagaagtgatcgaagcggccaaagcggcgtacgctcaccatttcattcaggaacttcctgaacagtataaaacgccggtgggagagagaggagcgtcgttgtcgggcggacaaaggcagcgaattgcgatcgcccgggcgattctcaaaaacgccccgattctgctgctggatgaagcgacttccgcgctggataacgaatcccagcattgggtacagcaggccttgaacgtattgatgaaggggcgcaccaccattctgatcgcccaccgtctcagcaccgtggaacatgcggatttgattaccgtcatgaaccaagggacggtcgtcgagcggggccgccatcaggacctgctggcgctcgggggttattacgcccggctgtacggctag

SEQ ID NO: 21 - protein, 608 aa, Paenibacillus polymyxa E681
MEADRQPSVQEQGAAAPSKRQTAYAAWKAFRWLMSYVSRHKGWMIVGTLSAIAAAVIEIWTGSLIEQLTTQAEKGAGPIVLQIVYTVFVVILIGVPAKFFMSFGVERSSASAVQDIRNRLMRHIGKLPISYLEKQHSGDVLSRINNDLQLIQQFMIRDLAQWFYHPLLFIGCFAYLIYLQWELMLYSLLLFPVALLVSQWIGKQLERLTEEAQANMGRMNVNLQDTLGGMPIVKSYLLSGMLSRSYQALLQLTAQKKLAVKKREAWVNPLLSTLMISPIIFAVSYGSYLIYKGQLGAGELIAFLYLLNLCLEPLEHIPELITRTFEMAGALRRVSEIVEQPTETENGRSLPKASAAPIEFQNVTFGYEEKSPILRNVSFSVPEGKTIALVGASGGGKSTVFKLVCGFYPLPEDQGEIRVFGSLIHGADPEQLRSHFSVVTQDSYLFSGTIAENIGYGREVASMDEIIEAAKAAQAHSFIMQLPDGYQTYVGERGGFLSGGQRQRIAMARAFLKDASVLLLDEPTSALDPESENAVQEALGVLMKQRTTMVIAHRLSTVQNADEIWVMEQGSIVEKGTHEQLLKMKGLYAQSYYQEFTESAERREVAYT

SEQ ID NO: 22 - protein, 577 aa, Paenibacillus polymyxa E681
MKKGGWLSQVKELGYLLMFMNRKRKTQYAIGLAVTALTQTLFLIAFSLVVHNLVDFAVSRDTSLMVEAFIILGAALFLENVISPWFIYLYQRSVELTVLNIRERLYDKLCRVRPRFLEQTHHGDLLSRVNNDVTTVEFTFSQVYFVLLLQVVFCIGSIVSMVLIDWRFAGVSFVILLLSSVVSLKFARDIRALSEQGLQTLGKMTEKFKDFMGGIQIVKLFRIRTIYGQYEALNEQMTQTLRQTAQKNGMQAAVNHFISYVTFCGIIVIGSLLYAHGLMGMGSVAALAVLQVNLTHALLNLGMVLSMTQNSLAGAHRIQEVLREEEEPERLGSPHSELVSEAAVEFRDVEFSYQADKKVLVDISMQVFPGQVAAIVGASGSGKSTLIKLLLGFYPVDSGEILLQGKPFGHYTLDEIRRQIAYVPQEPFLFTGTIEENIRYGNPDATDEEVIEAAKAAYAHHFIQELPEQYKTPVGERGASLSGGQRQRIAIARAILKNAPILLLDEATSALDNESQHWVQQALNVLMKGRTTILIAHRLSTVEHADLITVMNQGTVVERGRHQDLLALGGYYARLYG

SEQ ID NO: 23 - protein, 297 aa, Paenibacillus polymyxa E681
MAFEKETLFWNEKFGNDDYTLTRLPYSKAPSSLAPIMTTVGGSLSEEAAQRVLQMSKGAPLAAFMILLAGVQSLLHKYTGASDILVGMPVVRKPTETRRSVNHTVILKNSLSAGATFKTLLNELRTSLPRAIQHQHIPFLKMTEKLDLQYADGIPVVHTLVSLKELHLDEIGQNVVTDCSFEFSLTGGTIQLALSYNEHLYDSEFMTRVVGHLNRLLVVGLHELELDIVRADMLSEDEKFQLLQSFNDTEKDYPRDRTIHQLVEEQAKRVPEATAVVFEGRRLSYAELNERANRLAR

SEQ ID NO: 24 - protein, 505 aa, Paenibacillus polymyxa E681
TLRSIGVLPNQLVGLMVRRSLETVVGILAVLKAGGAYVPIDPEYPEERIRYILENSNAQLLLTQRELLQLQVPFEGTVVALDDEQAYSDDGSNLEPASGPNDLAYVIYTSGTTGNPKGVMLEHHGLVSLKLMFADRLGITEHDRIVQFASLSFDASCWEVFKALYFGAALYIPTAETILDNRLFESYMNEHAITAAILPPTYSAYLNPDRLPSLTKLVTGGSAVSAEFVQQWKRKVHYFNAYGPTEASIVTTLWDADEEQPEGRVIPIGRPLANHRIFILDAHLQLVPPGVDGELCVAGVGLARGYLNHPELTAEKFVEHPFAPGERLYRTGDLARWLPDGNVEYLGRIDHQVKIRGFRIEIGEIEEQLLKIDSVQETIVIAREGKSGQELCAYLVAGRPLTLGELRSALAQKLPNYMIPAHFVQLPQMPLTPNDKIDRKALPAPEGNALTGGAYVAPRNEAERTLADVWQAVLNADRVGVTDHFFELGGDSIKSIQVSSRLHQA

SEQ ID NO: 25 - protein, 18 aa, Paenibacillus polymyxa E681
GYKLEIRDLFKYPTISQL

SEQ ID NO: 26 - protein, 64 aa, Paenibacillus polymyxa E681
SLHVKPIGRTIDQGEITGETALTPIQHWFFESSFADPHHFNQSVMLYRKERFDEETVRQVLQKL

SEQ ID NO: 27 - protein, 17 aa, Paenibacillus polymyxa E681
AEHHDALRMVFRKTEQG

SEQ ID NO: 28 - protein, 460 aa, Paenibacillus polymyxa E681
FSARNRAIQDGGLFTLDVFDFKDAENTEQAVEAKATDIQAGIDLENGLLLKAGLFRCADGDHLLLAVHHAVVDGVSWRILMEDFALGYEQAGKSEEIRFPAKTDAYRTWSEQLAAYAQSPEMTKERAYWQAMEQIAVPAVPKDLDVDVTTQQDSESLFVRLTPEETELLLKRVHRAYNTEMNDILVTALGIAIRKWTGHERVRINLEGHGRESIGTDIDITRTVGWFTTKFPVVLEPETDRDLAYQIKQVKESLRRIPNKGLGYGVCRYLSKSEDGFVWGAEPEINFNYLGQFDDDVSQVEIGISSYSSGSPASDRQARSFVLDINGMVLDGALSLDLSYSRKQYRKETMEAFAQRLEQSLRELITHCAGKENTELTPSDVQFKGLTIAELEQIAQRSGHLGEIENIYSLTPMQKGMWFHSALDRQTAAYFEQTRFTMRGALDVQLFERSWMELAKRHLV

SEQ ID NO: 29 - protein, 9 aa, Paenibacillus polymyxa E681
LRANFVKGP

SEQ ID NO: 30 - protein, 437 aa, Paenibacillus polymyxa E681
EGEPLQVIYRDKPVGFEYEELLHLQADEKQAYLDKKAEDDKLRGFDMEHDALVRVTILRTEEQSYHVLWSFQHILMDGWCLPQLTQELFEMYSALASGKQPAGDKGSDYGAYIEWLEKQDDQAASGYWTAFLADYEGQTVLPGQKEPAPSGIFTADHVTAELGKDLSERMDRVAKQRLVTVNTLLQAAWGVMLQKYNGTNDAVFGSVVAGRPAEIPGIESMIGLFINTVPVRVTSEADTVFADLMAKLQERALESGRYDYYPLYEIQARSVQKQNLINHIIAFENYPVDEQMEQAGDQQHGDLTIADVQMEEQTNYNFNVTVVPGVEIEIRFDFNAEVFDKDSIERLKGHLVHLLEQVTDNPEITVGELELVTEGEKADLLGRFNDTTTEFPRGKTLVQLFEEQAELYPDNVAAVMNERQLTYRELNERSNRLARKL

SEQ ID NO: 31 - protein, 530 aa, Paenibacillus polymyxa E681
ERSNRLARKLRETGVEADQLVAILAERSLDMVVGILAILKAGGAYVPVDPDYPEERIRFMIEDSGAPLLLIQKHLHEKTDFAGTRLELDDFVWGDRGADSADALDASNLEPISGPGNLAYVIYTSGTTGRPKGTLIEHKNVVRLLFNDKNLFDFGPSDTWTLFHSFCFDFSVWEMYGALLYGGKLVIVPSLTAKNPADFLALLGREQVTILNQTPTYFYQLLREVLADHPYDLRIRNVIFGGEALSPLLLKGFKTKYPETKLINMYGITETTVHVTYKEITWVEMEAAKSNIGKPIPTLRVYVLDENRRPVPIGVAGEMYVAGEGLARGYLNRPDLTAEKFVDSPFAEGEKLYRSGDLAAWLPDGNIEYLGRIDHQVKIRGYRIELDEIETQLLNVRGVEEAVVLARQDGGGEKALVAYFVADRTLTVSEMRTSLAQGMPGYMIPSYFVQLERMPLTTNGKVDRKALPEPQGGIQTGVEYVAPRNWTESQLVKIWEEVLGYSGIGVLDNFFELGGHSLRATNLVSKIQKE

SEQ ID NO: 32 - protein, 20 aa, Paenibacillus polymyxa E681
MNVELPLRDVFRYSTIEEMA

SEQ ID NO: 33 - protein, 63 aa, Paenibacillus polymyxa E681
LAISRIGEQSFSSIPLAGARAYYPLSSAQKRLFILNQLEGADQSYNMPGVLLLEGSIDRSLLE

SEQ ID NO: 34 - protein, 21 aa, Paenibacillus polymyxa E681
KAFRGLIARHETLRTGFEIVQ

SEQ ID NO: 35 - protein, 425 aa, Paenibacillus polymyxa E681
GEAIQRIYESVDFAVEYRHASEEEAPEVVQAFIRPFDLAKPPLLRAELVELAAERYLLMFDMHHIVSDGVSMDVLVEELVRLYGGESLEPLRIQYKDYAVWQQSDEQKVQLKREEAYWLDRYRGELPVLEMPTDYPRPAVQSFEGQTLTSFVDEATNEGLKQLAAQRGTTLYMVLLAAYTVLLHKYTGQDDLIVGTSIAGRTHGDTQPLIGMFVNTLALRNYPASKKTFLSYLEEVKETTLGAYEHQNYPFEELVDKVQVSRDLSRNPLFDTMFSLQNLEDKEFELEGLKLSSYPSEYGTAKFDLSVDVTEENGGLECSFEFATALYKESTIRRLSTHFGHLLAAIASRPDAKIAELNLLTAEEKEQILGAFNPAQLEAAPAAAFHRLFEEQVERTPEEAAVVYENERLTYAELNERANRLAATL

SEQ ID NO: 36 - protein, 557 aa, Paenibacillus polymyxa E681
TLRASGIGRETIVGILAERSVDLLVAVLAVWKAGGAYVPLDPDYPADRVRFMLEDSGAKVLLTQTALRERAEAWLGEEELALAAVLYLDDEASYNEERANAPVGSGMVSGKLTDAVDDGDESHQNVDTDGFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHEQRLDMSWMELLITSSDSCSVADYRTLQERFGSLFRIINAYGVTEAAIDSSFYDEELTKLPQTGHVPIGKAWLNAKFYIVDAHLNPVPVGVLGELVIGGVGVARGYLNRPELTEEKFVDSPFAAGERLYRTGDLARWMEDGNVDFIGRIDNQAKIRGYRIETGEIESQLLRVEGVREAVVLVRSDANGQKALCAYYTPDTGAELAVNDLRGALAQELPGYMIPSYFVELERLPLTPNGKIDRKALPAPEREAGSGTEYVAPRNELETKLTAIWQEVLGLAKEIGVHDNFFDIGGHSLRATTLVSKIHKE

SEQ ID NO: 37 - protein, 18 aa, Paenibacillus polymyxa E681
LNVDLPLRDVFRHSTIES

SEQ ID NO: 38 - protein, 65 aa, Paenibacillus polymyxa E681
MAAAISRLDEQTFVAIPVADDREVYPQSFAQKRLFILNQLEGAELSYNMPEAMLLEGALDRTRFE

SEQ ID NO: 39 - protein, 22 aa, Paenibacillus polymyxa E681
EAFRKLVARHETLRTGFEMVDG

SEQ ID NO: 40 - protein, 424 aa, Paenibacillus polymyxa E681
EASQRIYQDVNFAVEFYRVDEQEAEETVHRFVRPFDLAKPPLLRVGLVELAPERHILMYDMHHIISDGVSMEIFVEEFVRLYGGEQLEPLRIQYKDYTVWQHSQEQKERLQRQEAYWLDMFQGELPVLEMPTDYPRPAVQSYEGQTLEFFFDASKTDGLKQLASETGTTLFMVLLAAYNVLLHKYSGQEDVIVGTPIAGRNHGDVQPLIGIFLNTLAIRSYPASEKTFLSYLNEVKETTLHAFEHQNYPFEELVDKVQVTRDLSRNPLFDTLFTMQNTENEEFELEGLRLIPYPSALDTAKFDISLDVGEENGGLDYSFEYATALYKRETIERLAKHYEQLLVTIVSRPDAKIAELNLLTAEEKGQILGAFHPAQLEAAPAAAFHRLFEEQAERTPEAVAVVYENDRLTYAELNERANRLAATL

SEQ ID NO: 41 - protein, 19 aa, Paenibacillus polymyxa E681
RASGIGRETIVGILAERSV

SEQ ID NO: 42 - protein, 509 aa, Paenibacillus polymyxa E681
DLLVAVLAVWKAGGAYVPLDPDYPAERVRFMLEDSGAKVLLTQTPLRERAKAWLGEEELALAAVLYLDDEASYSEERANADSFHEARPEDLAYVIYTSGTTGKPKGVMIEHRSLVNTAASYRREYRLDQFPVRLLQLASFSFDVFVGDIARTLYNGGTMVIVPKDDRIDPSRLHYWMEREQVTIFESTPALIVPFMEYVHEQGLDMSWMELLITSSDSCSVADYRTLQERFGSLFRIINAYGVTEAAIDSSFYDEELAKLPQTGHVPIGKAWLNAKFYIVDAHLNPVPVGVLGELVIGGVGVARGYLNRPELTGEKFVDSPFAAGERLYRTGDLARWMEDGNVDFIGRIDNQAKIRGYRIETGEIESQLLQVEGVREAVVLVRSDANGQKALCAYYTPDTGAELAVNDLRGALAQELPGYMIPSYFVEMERLPLTPNGKIDRKALPAPEGEAGSGTEYVAPRNELETKLTAIWQEVLGLAKEIGVHDNFFDIGGHSLRATTLAGKVFKE

SEQ ID NO: 43 - protein, 18 aa, Paenibacillus polymyxa E681
LNVNLPLRDVFRHSTIAA

SEQ ID NO: 44 - protein, 65 aa, Paenibacillus polymyxa E681
MAEAIARMERREHEAIPQAEEREYYPLSSAQKRLFIQHTLDGADQLYNMPELVQVEGEFDLERLE

SEQ ID NO: 45 - protein, 21 aa, Paenibacillus polymyxa E681
AALRKLITRHESLRTGFEIVK

SEQ ID NO: 46 - protein, 381 aa, Paenibacillus polymyxa E681
GEAVQRIYPQVDFAIEHYQADKEDAAQIEQIVRSFVRPFDLGKPPLLRAGVIELEPNLHILLFDMHHMVSDGVSMAIVIDEFSSFYAGEELPPLRIQYKDYAVWQQSKAHRERIGRQEAYWLQTFEGELPTADLPMDYERSAARSYEGAHLEFDVEASLSAQLRELAAERESTLFMVLLAAYTVLLSKYSGQEDLVVGTPVAGRTNADLEPIIGMFVNTLAIRNRPSGDKTFLSYLEEVKETALGAFENQDYPFEELVERLNVKREPGRFPLFDAVFDLQNIEERDAELEGVSLKTYELDHLEEAKFDLTLFMYENNGALSGGFFYATKLFKEAMIRTLTEDYLRVLSQIAKNPQLELSRIECHKPAAGAKSAVDTIEFAF

SEQ ID NO: 47 - protein, 300 aa, Paenibacillus polymyxa E681
MKSLFEKEEQYWSGKFDADDSLSFLPYSQSSKLSAHGEAAAEPGLLHRTLPSQLSERIISLANGSDLALYMIVLAGVKSLLFKYTGRDQVLVGMPSYSADPDGTPPPHDILVIKTSVSRQTTLKTLLGGIKASIGEALEHQHLPFRKMVEPLHLDYTGDGLPVVNTVVSFAPIHPEPQGNRVAADTVFRFDRQNHSIELEISFDGQRYERAFVEQAADHLVRLLSVLLFQPDLKLGQADVLSPDERETLLKRFNDTETEFERGKTIYGLFEEQAELYPDNVAAVMNERQLTYRELNERSN

SEQ ID NO: 48 - protein, 530 aa, Paenibacillus polymyxa E681
RLARKLREAGVEADQLVAILAERSLDMVVGILAILKAGGAYVPVDPDYPEERIRFMIEDSGAPLLLIQKHLHEKTDFAGTRLELDDFVWGDRGANSAEALDASNLEPISGPGNLAYVIYTSGTTGRPKGTLIEHKNVVRLLFNDKNLFDFGPSDTWTLFHSFCFDFSVWEMYGALLYGGKLVIVPPLTAKNPADFLALLGREQVTILNQTPTYFYQLLRKVLADHPYDLRIRNVIFGGEALSPLLLKGFKTKYPETKLINMYGITETTVHVTYKEITWVEMEAAKSNIGKPIPTLRVYVLDENRRLVPIGVAGEMYVAGEGLARGYLNRPDLTAEKFVDSPFAEGERLYRSGDLAAWLPDGNIEYLGRIDHQVKIRGYRIELDEIETQLLNARGVEEAVVLARDDAHGHKQLVAYYVAETRLAANELKEELAKQLPGYMIPSHLVQLSRMPLTPNGKIDRKALPAPEEAAAGGAEYVAPRTLLEMKIVRVWQDTLGVPQVGVKDNFFELGGNSLSLMRLVQAVYDETGIE

SEQ ID NO: 49 - protein, 14 aa, Paenibacillus polymyxa E681
IPLNRQFHNVTVEA

SEQ ID NO: 50 - protein, 62 aa, Paenibacillus polymyxa E681
MAFGEGDLGLDKGGDSFIKLNKAGDLNVFCFPPGSGFGIGYRELASRLDGRFVLYGIDFIDD

SEQ ID NO: 51 - protein, 25 aa, Paenibacillus polymyxa E681
AADYEAMLNRYVDEIVRIQPEGPYV

SEQ ID NO: 52 - protein, 171 aa, Paenibacillus polymyxa E681
LLGYCFGGNLMFEVAKTMEKREYSVTDVLMVDSWIKDTLTPSETSEKELEETLADFDEEEKELMSNPLVRERVHRKVKATLAYEAQLMNSGTIPARIYELIAKDSEAFRLEHQLPSWRGATTQAYADYRLEGAHEELLELARVDETAVVIRDILEQVKRQIEAEAGVLHGS

SEQ ID NO: 53 - protein, 70 aa, Paenibacillus polymyxa E681
MRENTKEQYGLTQAQRRIWFMEIMNPGTSITMLSATYQITGEINTQLLEQAAAEIVKTYDVFRIRISGDL

SEQ ID NO: 54 - protein, 432 aa, Paenibacillus polymyxa E681
QNPTQWFEEPENVQARISRLEIGTTEQFYAWVKEVSEKPASVFDEHLHQFTIIHFVNGQVWLNLTVNHIIADGLSVNALLHAVMEKYLELRKGISSSYQAPSYLDYISAEREYEQSQRYQKGKEYWLTKYNTLPETTGIKSYPPFSIGSESNKLSITLDGSRYERILTFSEQYQVSLYTLFLSAMYALLYKLTDSIDVPVGTVFANRTSKKEKETIGMFVSTVATRIRLNPDRNVLSLIQTVSKENTADLRYQKYPYNQLIQDLREQHGRNDLSGLFRTSLEYLPLKIVEYEEIKVRLEAHFARHEMDDLLLRFDHMLNEGHVILHASYRTGLFETAEIDRIMEQYVTVLDQFLQTPELPIREISLLSDEERHRILNVFNPPVAGLSEGEAFHRYVEKFAREIPDHPAVVYMDKQLTYGELNERAERLASLL

SEQ ID NO: 55 - protein, 535 aa, Paenibacillus polymyxa E681
LASLLREQGVGKETITGIWAERSVELLVGVLAVWKAGGAYVPLDPDYPAERIEYMLSDSDASVLLTQRHLLERAGGWLADDRLKLQAVYAMDDEQIYNGDALAVEFESAGSAPQDLAYVIYTSGTTGRPKGVMIEHGSLVNTADAYRREYRLDQFPVRLLQLASFSFDVFVGDIARTLYNGGTMVIVPKDDRIDPNLLYGWIRDQNITVFESTPALILPFMQHIYEEGLDVSSMQLLITSSDACSVTDYRLLQERFGGQFRIINSYGVTEAAIDSSFYGEPLDKLPPSGHVPIGKAWLNARFYIVDAALKPVPVGVPGELVIGGAGVARGYWNRPDLTAEKFADSPFVPGERLYRTGDLARWLEDGNVDFIGRIDYQVKIRGFRIELGEIETALLRFPGVKQAVVTDRTDEQGEKYLCGYVAADASLQLSDLLSQLKQELPAHMVPARLVSLDKLPLTPNGKIDRKALPEPTGEVEAGREYVAPRTTLETRLALIWQQVLGIARVGVQDDFFDLGGHSLRASTLVSKIRKELQVE

SEQ ID NO: 56 - protein, 15 aa, Paenibacillus polymyxa E681
VPLREVFRYTTIEQL

SEQ ID NO: 57 - protein, 64 aa, Paenibacillus polymyxa E681
AQRIGGLRQQETYEITKAAEAEYYPVSSEQKRLYVLRQLDGAERSYNMSAALLLEGKLDRMRVE

SEQ ID NO: 58 - protein, 21 aa, Paenibacillus polymyxa E681
HAFRALIQRHETLRTGIEQVQ

SEQ ID NO: 59 - protein, 427 aa, Paenibacillus polymyxa E681
GELVQRIYDEVEFAVDYFQASEREVEQVVEAYYHPFDLTKPPLLRIGLIEVAEDRHILLFDMHHIVSDGISTALLFDEFSRLYRGEELGPLRIQYKDYAVWQHSEAYGQMLQPQKEYWLEQLSGELPVLELPTDFPRPAVQSFDGRTVKFYIEKDRTEKLKELAARTGTTLYMVLLSAYTILMHKYSGQEDLIVGTPIAGRTQEEVQPIVGMFINTLAIRSRPERSKPYLSYLEEIKDITLGAFEHQNYLFEDLVESLHIPRATGRNPLFDTFFSLQNTENEQIVIEGLEQSFYPLENQTSKFELLLDISELDGQLECRLEYATALYKQETAERFARHYDKLLETIAAAPDGDIASLEMLKEEEIRELVRGFNDSEADYPRQQTIHGLFEEQAELYPDNVAAVMNERQLTYRELNERSNRLARKLRE

SEQ ID NO: 60 - protein, 520 aa, Paenibacillus polymyxa E681
RETGVEADQLVAILAERSLDMVVGILAILKAGGAYVPVDPDYPEERIRFMIEDSGAPLLLIQKHLHEKTDFAGTRLELDDFVWGDRGANSAEALDASNLEPISGPGNLAYVIYTSGTTGRPKGTLIEHKNVVRLLFNDKNLFDFGPSDTWTLFHSFCFDFSVWEMYGALLYGGKLVIVPPLTAKNPADFLALLGREQVTILNQTPTYFYQLLREVLADHPYDLRIRNVIFGGEALSPLLLKGFKTKYPETKLINMYGITETTVHVTYKEITWVEMEAAKSNIGKPIPTLRVYVLDENRRPVPIGVAGEMYVAGEGLARGYLNRPDLTAEKFVDSPFAEGEKLYRSGDLAAWLPDGNIEYLGRIDHQVKIRGYRIELDEIETQLLNVRGVEEAVVLARQDGGGEKALVAYFVADRTLTVSEMRTSLAQGMPGYMIPSYFVQLERMPLTTNGKVDRKALPEPQGGIQTGVEYVAPRNWTESQLVKIWEEVLGYSGIGVLDNFFELGGHSLRATNLVSKIRKE

SEQ ID NO: 61 - protein, 20 aa, Paenibacillus polymyxa E681
MNVELPLRDVFRYTTVESMA

SEQ ID NO: 62 - protein, 63 aa, Paenibacillus polymyxa E681
GAIASLEETQHSSIPKAEEKAYYPVSSAQKRLYVLHQLDSSELNYNLPSALQLEGALNEAKVE

SEQ ID NO: 63 - protein, 21 aa, Paenibacillus polymyxa E681
KALTTLVARHDMLRTGFEIVN

SEQ ID NO: 64 - protein, 427 aa, Paenibacillus polymyxa E681
GEPVQRIHPLVAFKVEKLQASEDQVAAILEGFIQPFDLTQPPLLRALLIELEKEKFLLALDIHHIGSDGLSMDVLLREFVRLYNGEELPELRIQYKDYAVWQQSEEQRQRIKRQEEYWRGVFSSELPVLELPLDFSRPAVQQFDGQTLTFTLDAEKSEALKRLAGDSGATLYMLLLAAYSVLLHKYAGQEDIVVGTPIAARSHADLQPIIGMFVNTLALRLRPAAERTFLDYLQEVKETTLGAYEHQDYPFEELVEALQVSRDLSRNPLFDTMFSLQKHESLDLTLEGLQWSLFDIEEKTAKFDLSFDIVEADNELVCKIEYATSLFRQETMVRLAGHYEQLLASILAQPGARISDLDILTDSEKHDLLVGFDVSSSALAKQPAAEGTGLEADESWRERTFHELFEEQAERTPGALAVVYEDSKLTY

SEQ ID NO: 65 - protein, 31 aa, Paenibacillus polymyxa E681
AELNAKANRLAYALRARGVKPEQVVGILAGR

SEQ ID NO: 66 - protein, 556 aa, Paenibacillus polymyxa E681
SAELLVGVLAVWKAGGAYVPLDPDYPAERIEYMLADSGASVLLTQTCLLEQAEAWRSDGALVLQTVLALDDAATYSLGAAEAAVGVQALGEAGAEAEALAQAETAAAEKSATAEAEKNVLAADLASNPANVNKPSDLAYVIYTSGTTGRPKGVAVEHRSLVNTAAGYRRDYRLDQFPIRLLQLASFSFDVFVGDIARTLYNGGTMVIVPKDDRIDPTRLYGWIRDYAVTVFESTPALIVPFMEHVHAEGLDLSSMQLLITSSDACSVADYRTLQERFGSQFRIINSYGVTEAAIDSSFYDEPLEKLPKTGSVPIGKAWLNAKFYIVDANLKPVPIGVLGELVIGGAGVARGYLNRPDLTAEKFVDSPFAAGERLYRTGDLARWMPDGNVDFIGRIDNQVKIRGYRIELGEIEAAMKNFAGVRQALVIDRTDERGQKYLCGYVVADSSFDLEGLVAHLDAALPSHMVPSRIMRLDQMPLTPNGKIDRKALPVPEGSIRAEAAYTAPRTPAEQALASVWQSVLGVDQVGTMDNFFALGGDSIKALQVSSRLLQTGYKL

SEQ ID NO: 67 - protein, 14 aa, Paenibacillus polymyxa E681
VMKDLFHYPTISAL

SEQ ID NO: 68 - protein, 61 aa, Paenibacillus polymyxa E681
SLQLQTAERTASQAEVTGEVILTPIQRWFFEQNPADVHHSNQAFMQFSKEGFDEEALRQAV

SEQ ID NO: 69 - protein, 20 aa, Paenibacillus polymyxa E681
RQIVVHHDALRTVYRQADNG

SEQ ID NO: 70 - protein, 459 aa, Paenibacillus polymyxa E681
YTAWNRGAGENEALFDLEVVDFKGVGDVKEAVEAKANDIQASIDLENGPLVKLGLFRCDDGDHLLIAIHHLVVDGVSWRILLEDFAAGYEQALQGQPIRLPLKTDSFQTWAKQLADYANSPAMESEREYWQHIEQLTYEPLPKDFEQGRSKLKDSGLVTVRWTAEETEQLLKQAHRAYHTEMNDLLLAALGLALQAWSGRERVLVNLEGHGREDILPDVDITRTVGWFTSQFPVVLEPGHAQALGHQVKQVKESLRRIPNKGIGYGILRYLSAPREGEYFVLEPEISFNYLGQFDHDYESSSSQPSPFSPGSDSSPNAVMDYVLDINGMVSEGALELTIRYGETQYKRETVERLGTLLQSSLREVISHCLSKERPELTPSDVLLQDVTVEELERLSEHTVALGELENVYTLTPLQKGMLFHSLLDADSEAYFEQVTFDLYGSLNVEAFTRGLDTLVQRN

SEQ ID NO: 71 - protein, 11 aa, Paenibacillus polymyxa E681
EALRTNFITGW

SEQ ID NO: 72 - protein, 437 aa, Paenibacillus polymyxa E681
RDEPIQVVFRERKCEVYFEDIRSVSDEHPEKTIADFVSADKANKFDLARGPLMRVTVVRTGDESYHVIWSHHHILMDGWCMSFMIKEVFDTYFAFQEKRTLELPPVTSYSRYIEWLEAQDAAKASRYWSEYLAGYDQQTKLPQEKTQLKQGAFEAAEIDVELSKELTGQIERVARQQQVTLNTFMQTVWGLVLQIYNNSEDVVFGSVVSGRPAEIPGIESMIGLFINTIPVRIQGKAEERVADILRKTQDQALASGAYETFPLFEIQSLSEQKRDLINHIMVFENYPMEEQIEQVVGGGREALKIANIQSPEQTNYDLDITVIPEEHILLRFTYNALTFREDDIRQIHSHFAWALEKVAANPNILVNQLELLTAAEKEQILGAFNPAQPEAAPAAAFHRLFEEQVERTPEEAAVVYENDRLTYAELNERANRLAATL

SEQ ID NO: 73 - protein, 556 aa, Paenibacillus polymyxa E681
ATLRASGIGRETIVGILAERSVDLLVAVLAVWKAGGAYVPLDPDYPADRVRFMLEDSGAKVLLTQTALRERAEAWLGEEELALAAVLYLDDEASYNEERANAPVGSGMVSGKLTDAVDDGDESHQNVGTDGFHEARPEDLAYVIYTSGTTGKPKGVMIEHRSLVNTAAGYRREYRLDQFPVRLLQLASFSFDVFVGDIARTLYNGGTMVIVPKDDRIDPSRLHHWMERERVTIFESTPALIVPFLEYVHDQQLDMSWMELLITSSDSCSVADYRTLQERFGSLFRIINAYGVTEAAIDSSFYDEELAKLPQTGHVPIGKAWLNAKFYIVDAHLNPVPVGVLGELVIGGVGVARGYLNRPELTGEKFVDSPFAAGERLYRTGDLARWMEDGNVDFIGRIDNQAKIRGYRIETGEVEAKLLSVGGVKEAVVVVREDQEGQKALCAYYTAEEGLTAADLKRAIASELPGYMIPSYFVELERLPLTPNGKIDRKALPAPEGGAGGGREYVAPRTELEAKLAAIWQDVLVREKAVGVTDNFFDLGGHSLRATTLVSKMHKE

SEQ ID NO: 74 - protein, 18 aa, Paenibacillus polymyxa E681
LGVEFPLRDVFRYPTVEE

SEQ ID NO: 75 - protein, 65 aa, Paenibacillus polymyxa E681
MAAAMERLEIGSFMAIPAAEPSEYYPLSSAQKRLYILNQLEGAELSYNIPGAMLLEGELDRQRFE

SEQ ID NO: 76 - protein, 21 aa, Paenibacillus polymyxa E681
EAFRGLVARHETLRTGFEMVK

SEQ ID NO: 77 - protein, 425 aa, Paenibacillus polymyxa E681
GEAVQRIYEEAAFQVEYVQISAEQAEETVRQFVRPFDLAKPPLLRVGLAELAPDRHILMFDTHHIVSDGVSIDVLIEELVRLYSGEQLEPLRIQYKDYAVWQQSDEQKAQLAKQEAYWLDMFRGELPVLELPTDYPRPAMQSYEGRTLQLFMHSEKSEGLKRLAAENGATLYMVLLAGYTILLHKYTGQEDVVVGTPIAGRNHSDVQPLIGMFVNTLAIRSYPAADKTFLEYLKEIKETTLGAFEHQNYPFEELVDKVNVARDLRRNPLFDTMFALQNTENLEIQLPGLHLSTYASEEIVSKFDLSLDVTEIEEGLEYLFEYATALYKTETVEKLAAHYLQLLESILRNPSATIAELGILTPAEKEQILGAFNPAQPEAAPATAFHRLFEEQVERTPEEAAVVYENDRLTYAELNKRANRLAATL

SEQ ID NO: 78 - protein, 556 aa, Paenibacillus polymyxa E681
ATLRAGGIGRETIVGILAERSVDLLVAVLAIWKAGGAYVPLDPDYPADRVRFMLEDSGAKVLLTQTPLRERAEAWLGEEELALAAVLYLDDETSYSEERANAPIGSGMVSGKLTDAVNDGDESHQNVGTDSFHEARPENLAYVIYTSGTTGKPKGVMIEHRSLVNTAVGYRREYRLDQFPVRLLQLASFSFDVFVGDIARTLYNGGTMVIVPKDDRIDPSRLHHWMERERVTIFESTPALIVPFLEYVHDQQLDMSWMELLITSSDSCSVADYRTLQERFGSLFRIINAYGVTEAAIDSSFYDEELAKLPQTGHVPIGKAWLNAKFYIVDAHLNPVPVGVMGELVIGGVGVARGYLNRPELTEEKFVDSPFAAGERLYRTGDLARWMEDGNVDFIGRIDNQAKIRGYRIETGEIESQLLRVEGVREAVVLVRSDSNGQKALSAYYTIDGELTAADLKRAISSELPGYMIPSYFVELERLPLTPNGKIDRKELPAPEGGASAGREYVAPRTELEAKLVAIWQDVLGPITIGVTDNFFDLGGHSLRATTLVSKVHKEL

SEQ ID NO: 79 - protein, 18 aa, Paenibacillus polymyxa E681
SVDLPLRDVFRHSTIEAM

SEQ ID NO: 80 - protein, 64 aa, Paenibacillus polymyxa E681
AEAISQLERQEHLSIPVLDKRDYYPLSSVQKRLYIQQQMEGAELSYNMSGMTVLVGRLERNQFE

SEQ ID NO: 81 - protein, 21 aa, Paenibacillus polymyxa E681
AALKGLIARHEILRTGFEMVD

SEQ ID NO: 82 - protein, 377 aa, Paenibacillus polymyxa E681
GEPVQRIYPDLKFAVEYTKAMESETKSIVDGFVRVFDLERPPLLRVGLVEMEAERHLLMLDIHHIVTDGMSMGIFVEELLRLYNGETLEPLRIQYKEFAAWQQSEPVKERLKRQEAYWLDVLEGELPTLELPTDFVRPAARSFEGDVLPFSIDKQMTDSLQRIADENGATLYMVLLAAYSILLSKYSGQEDFIVGTPVSGRTHADLEPLIGMFVNTLAIRHYPSGEKTFLAYLNEVKETMLGAYEHQDYPFEELVKKLQAPRDQSRNPVFDVMFALETKEDNVQSFGDIKIESYPETHTVSQFDLTLVISLLDEGMNGQFEYATKLFTRNLIDNFAQDLLVIITQICEQPSALLKDISLNGQSEQEQDVLEAIDIIF

SEQ ID NO: 83 - DNA, 89 bp, Artificial Sequence
  Synthetic construct:  Foscm-TCF primer
tatcgagattttcaggagctaaggaagctaaaatggagaaaaaaatcactggatataccaccgttgatagatacaagagaggtctctcg

SEQ ID NO: 84 - DNA, 90 bp, Artificial Sequence
  Synthetic construct:  Foscm-TCR primer
ggcaccaataactgccttaaaaaaattacgccccgccctgccactcatcgcagtactgttgtaattcataacaaacgggccatattgttg

SEQ ID NO: 85 - DNA, 32 bp, Artificial Sequence
  Synthetic construct:  CatF primer
aaaggatcctcatgtttgacagcttatcatcg

SEQ ID NO: 86 - DNA, 29 bp, Artificial Sequence
  Synthetic construct:  CatR primer
aaagaattcccacgccgaaacaagcgctc

SEQ ID NO: 87 - DNA, 28 bp, Artificial Sequence
  Synthetic construct:  Kd4kanF primer
ccatcgatgtgtaggctggagctgcttc

SEQ ID NO: 88 - DNA, 28 bp, Artificial Sequence
  Synthetic construct:  Kd4kanR primer
ccatcgatatgggaattagccatggtcc

SEQ ID NO: 89 - DNA, 95 bp, Artificial Sequence
  Synthetic construct:  PmxEckF primer
gcattcaataacaaagattatgccgtttggcagcattcccgaagcttacgggcagatgctccagccgcagaatcatgtttgacagcttatcatcg

SEQ ID NO: 90 - DNA, 90 bp, Artificial Sequence
  Synthetic construct:  PmxEckR primer
gcagcacgtccatggaaaggccgtcggaaccaatatgatgaatatccagcgcgagcagaaatttctctttccacgccgaaacaagcgctc

SEQ ID NO: 91 - DNA, 22 bp, Artificial Sequence
  Synthetic construct:  PmxEdelF primer
gtctcggatggcatttcgacag

SEQ ID NO: 92 - DNA, 22 bp, Artificial Sequence
  Synthetic construct:  PmxEdelR primer
agaagtcgagaggcagctcaag

SEQ ID NO: 93 - DNA, 21 bp, Artificial Sequence
  Synthetic construct:  ydiO-up-F primer
taatgagttagatgaaatacc

SEQ ID NO: 94 - DNA, 30 bp, Artificial Sequence
  Synthetic construct:  ydiO-up-R primer
tttggatccttatcattcctagtattacac

SEQ ID NO: 95 - DNA, 30 bp, Artificial Sequence
  Synthetic construct:  ydjA-down-F primer
tttggatcctgttattagtcggaatgaatg

SEQ ID NO: 96 - DNA, 32 bp, Artificial Sequence
  Synthetic construct:  ydjA-down-R primer
tatctgcaggaataaacagaaaggaaagactg

SEQ ID NO: 97 - DNA, 91 bp, Artificial Sequence
  Synthetic construct:  1730-12DF primer
actgcatgtccccagtgcatcggtccccatacggatttatacgggtaatgttgatagaacaagtgatattggtatgtttctctttgatgtc

SEQ ID NO: 98 - DNA, 91 bp, Artificial Sequence
  Synthetic construct:  1730-12DR primer
agattatcggctgaactaccatttaatggctgaattgggctggatgaatgatccgaacggcttcattcaagaatggcgattttcgttcgtg

SEQ ID NO: 99 - DNA, 20 bp, Artificial Sequence
  Synthetic construct:  pmxAF primer
taacgttttcaccccattgg

SEQ ID NO: 100 - DNA, 20 bp, Artificial Sequence
  Synthetic construct:  pmxAR primer
gggagcttggagctttgctg

SEQ ID NO: 101 - DNA, 20 bp, Artificial Sequence
  Synthetic construct:  pmxBF primer
tccacaactcgagctaagcc

SEQ ID NO: 102 - DNA, 22 bp, Artificial Sequence
  Synthetic construct:  pmxBR primer
acttaccgctccagtactgttc

SEQ ID NO: 103 - DNA, 21 bp, Artificial Sequence
  Synthetic construct:  pmxCF primer
gaacaagtcaagcggcagatc

SEQ ID NO: 104 - DNA, 21 bp, Artificial Sequence
  Synthetic construct:  pmxCR primer
ctttcacttgcgagagccatc

SEQ ID NO: 105 - DNA, 21 bp, Artificial Sequence
  Synthetic construct:  pmxDF primer
caggaatttaccgagtctgcc

SEQ ID NO: 106 - DNA, 21 bp, Artificial Sequence
  Synthetic construct:  pmxDR primer
gtcgcattcgcaagcaggaag

SEQ ID NO: 107 - DNA, 24 bp, Artificial Sequence
  Synthetic construct:  pmxEF primer
gagcggctgaaacgtcaggaagcc

SEQ ID NO: 108 - DNA, 22 bp, Artificial Sequence
  Synthetic construct:  pmxER primer
ctgcttcgcctgtatgattgtc

SEQ ID NO: 109 - DNA, 71883 bp, Paenibacillus polymyxa E681
  misc_feature (8194)..(23055): CDS of pmxA
  misc_feature (23210)..(26518): CDS of pmxB
  misc_feature (26508)..(28334): CDS of pmxC, note: 5'- and 3'-end overlap with pmxB and pmxD, respectively.
  misc_feature (28331)..(30064): CDS of pmxD
  misc_feature (30295)..(49233): CDS of pmxE
ggatccggcttacgctgaacattactgggatcgggagttcattaaagagctcaagcttccagaagtcatcgacatcatcaattgttgtctgagcgattcggtctgttcgaattgggcccaaaggcgcgctttgaatatcgtctactacggcgacatggacgagacggtaagtacaattctagatcatttccaaagctgggaaggagacttgctcgacgatgcattccatgttctttataaattatgtccggatgatcggttgggatcaatgaagttttttctcgatcactattcctatcgaaccaatcatgtggtcttccctctattaaaaagattgtacccgaatcatctgacattgatggaattgttgaaatacatgctcgatctattcgttgggggagactctacttccggttatatccgttcgattgtccaaacgttgtccttggagcagctaggaaaacttagtgatacgatagctaatgctcctaaatatgcgaatcggcagaactcctcttccgtctatagggaggtgtatgcggaactggccaaccgaatgaacgaaagtgaagcggagttgctgcatcgtttcgagcggctggagcagcgtatgtgggaacacggttttatgacggaacctgctccgaaggagcagcccgctgcaaaacagctgaagtggccgcctgctaggcgagtttttgagcttgctgccgtcctggaactattggatcgaatggaaagtggacaaaccagtgcatgggattcgttaacgaagcatttaaatccgcatgatttgtataataagctcgattttaattcgaatgactttttgcaatctgtaggttggaaacaagtcaacggcgacacaagagcacgtattctacaggcagcaaagcagttcattataaccccccctgctgcgatggaagaccgcgaccggtttggatacttgttgaacattcttgatgcgattcagctcgtatttatgaaggataaggcatttttggtaacattgtctctggaagctacgcatcgatgctcggaagctgttaccaacccgcaaatcagtcagtacgtggaggggatggaaatcgtcaagctgtttcaccgtctctaccgggaagaaactttaaatggtattcttcgttatgcacgccgtttgtcttgggggtggggggcacgccatacggtaaccagtcaactcgtaaactgctgggatgaggatacggcattccggttgctgacgctgatgaaggacgaaacggtcgatcttgaagctttcgggcttatcattagtattttgcttgagcagcgccatccgacgatcaagcaaattgtcgcgtctcttgttgatgaagggtggaatccctctaacgcagaagtaagagaacgtgcatcagaagcagtggccattatgctggatttctcagaagacgcaggttgttcaatgctgcggacaattttacaagaaaatacagcatacgccaaaagcgttatcgaacgttatttgacaacgttcagaaattattcatttcaagaaaaatggccaccggaagcgattgccgaattgttcgaatggctgaacgccaacgaaatcaagccctcctataaattcaatgagctgaagacactgctgcttcgggagttggaggatcgtaaaacggaggaatcttatcgacagattaaacttcttagcgaacggctgccgaattcggaacgtgtgcagtcagcgtggttttttattcgcaacgactatttgcaaacgtcttggaatcctccgctgcctgaagcgattgtaaagacgatcggcagaaaaaagaaaatgccgatatttaacgggcagcagcttattgaactcatcaaagagattttggaggactacgagagggcgctccattcggaaaatccgctcatcttcacgatgtggaataaaaacggagacaagcaagttccgaaaacggaaaacgagttttccgatctcatcaaagtgcgcctcgcggatcaactgctcgaatatggaatcatcgtcagtcgggaagtagagctaagtagacacatttacgaaggagggacagagggagagcggatcgacattaaggttgatttgtgtacgacccaaaaagaaacgatatcgttgctgattgaggttaaaggttgctggaaccggacactgaagactgcgatggagaatcagctggttcgtcgttacatggagcaccataattacgactatggcatgtacttgataggttggtttctatgtgatggatggaaagactctaaagatagccgacgtaagacgactccggctatgccgatcaacgcagccaaacagttcttcagtcagcaggctgaaagtttgtccggtacatataacaagcatgttagttcgtacatcttcgatgcaacgataagaagttgagtgtgaggaaaaacacaaagggcaatcgagcatgttggaatttattagatgcaattgtcgaaacggcttcctccgaggtgtattaccttagggaacatttgatcaaatctcgtagagtttctaatgatctttctaggttattatgaaatgatcaagatagagtttaagtttgtgaaaaaatgaaattgatagttatttatctacaacatgtttagaaggagcggattctacatctagaactgtagcgattaacatcttaatatttacagtatcctaactgtgtttatattctcattttaaggatgttatgactatttctatttgatgtagcgatgttctaaaagaaagttttaagccatgagttgagccaattaaggtaattggagggatcagaactaattggaaaaactagtttttagccgaaaaggattcgactcagattcaggttacggatactcaccctacgatcctgcaactggaaaatatgtactgctgcccatcccagaggagaagatctcctcccaaaatattagatatagagatttgatgctcaaacccgattatttagacattaaagggatctcaaatctgaatgatttggtacaaaccaacagcttggcttatagtaggaagtcacagaatgtcgccaaaagtggctttgcccatttcgatcccatgttgggggattgtccgtggttggacggagctcccaatatcggagcctttgggcaatcagaagctgcggctggtcatttgcgaattaacgaggtgaagacaggcagcatttttctctttttcagccgttttaagccaatctctgggcgtgttcatccgttcgatccagaggccggctggagcaaagggatttattatatctatggctggctcaaagtaggaaaagtaattacagcagttaattactctgaactaccgcagaaggttattgattcttttcacccacattcaacttgtgatgattttcggtacagaaagaacaatacgatcttcttacctgctgaaaagttgttcgatggatcagaaattcctggctatggttattttccgagacttaccaactgtttgaaattgtcttctgatttccataaaaacataccgagtatatggcgattaccatcattctttaatgaagagttgtatcgtcctacttatttgaaaaacaaaaaaaagtcggagcaacgctggatgatatgtgaagataaaaaaaattgttttgttcagacaacagggcgtggacaggagtatatctctaagttagacaagaagagttctgcttggatcaagagtttatttaaggaggagtgttattaaagtccctaaaaaaaattcttggaaattgggcaacatagagattttgtaagtttatctaactgagtccaaattcgattgataactggtactggaaacaccataagaaagacttaattcaattttttaatcaacgttggaataatattgataaaaaattagccagttatacgaatttatatatcaagaaaccccactctatcagcaaacttttaacatttagttattcatatttcaaccaagatcgcgaagaatctttagaataaattttagttactaacattaacgtaaatgaaaaataagggtgtgtagctggttaccaacattaatgtaattcaaaatattgatgaattacccgacattacttgtaagtacgagatttctcagttaccaactttaatgtaactaaacactaatttgtcttcggacaataaagttgtgtactaaatattaataaaaaataacaacaatatctcttcttagtaagtatttaacaaaagtccgatgagcaagtatcatcgggctttttttattaaattcaggaggcgactgctttggctcaatcagagcgagtatagttgcatgacaaatcaaagggctttgaaccctttcctgtattggtatcttaagtaattgaagcaggagaaattcaagtttctgttgaaaacagtatgagaaatcaagagcttattgtcgcgatgaaaaaaatgtttttttatctaaaatacaattaatatctaatatatatataattattataaattaagtgtttatttcatttttatggatagtgggtgaaacaatgaagacgttgggtgaaaaaataaagagtataagaaaattaaataagcttaatcaaactgacttttcatcagttcttggtatttctcaaggtacactgagtgaattggaaaaagataagtacaaaccatccttggaaaccgtaactgctctaaaactaaatttcgatgttgatttagattggttgttacttgatgaggcggcaactttttatagtggattatttcaagttaagttagatgatcttgaatcaaaattaatctcaggatttcgaaagttagacctgggcgataaacaggaaatagaggggattgttgatttgaagttaaagcggtatagagataaatgaacctttgcggagccgtgaaggggactcattattgcaaagccttcagtagttatgttttaagttcacattagacatatgatccatccaattgagatggacacacggctatccatataaatatggaagaagaaagtcccaattttttttactatagggtctccgaagcaaaaagtgattgatgttatgggaactttcgacatcgatcatcggaaactcatggacttatgggaatcaaatgtggaattggactctaatgatcatatcattgggtggaataatatcaaccataatttgaaagtatctattggctcaagaagaaggggggccgctccatttacgataggacctttcatccaagatgtaattgatggcatgggcacaccgacgtctataagatgttcgttacgagtcctggtttgaatattagtgactctttggagtatatgcgtacactcgtatatccttctacagctctgcgaagccatgagtcggagtggtcaaagaggaaattcaaagaatagagcttccttttggaagcttgaatgtagtgatcccaagtccgcagcttaatgtcaaagatgcacttggtcaattaagtgaggattctttagtttgtgctgggcgtattaattacgagttattgatggagtatgctgcaaaaggtttctttaaaaaatctgagattaattggtttcgtcagttaaaaaatataacgactaaatatatactgaccaagctggagaaagacgaatggatgcataaattttttcataaaaagcaacccaatttaagattcctctaagcgacactatctgtagaagtgttatttttcaaagggattggagaataaaagaaagcaacctaagataattcgacggagaccaaaaatgtgaaaattacgtgctgagcgattgtatatcaacctcgataaccaagatatttatgatggtaagacctatttgtttattccttaaagcacaattcatggtataatatcactaaatatacatcctttataatttacgcttttttgtcgaaagttaatttattaagaagctagcctagtaccgaaatctctcttgaaaaattatatatcacacatcttaaagtcaggcaccttgtttttacaatggggctttttttgcattaagaaactacgaggtgcatggaggggcattatggctcaagcatatccaattcccgccatagaaaaatggataaaacaaggtaaagtccaaggtatgggaaacctgtaaagcaccaatatatccccatgcggatcgggcatacgagatcattcgaacaataaggcagaggagcgaattagggaagtcgtgaaggaacgactagcccctgcgaatatgcgtcacaaatcattccaagaacatttggaatacttaaacccgaaaatacagggttggcgtaactactacgttacgacctacagccaaaggaagatggctaaacgtgactggtacatccttcagcgactcacaaaatggtatgccaagaagcgtcaacgcgctcgatggaggagctcattacgtgaagtgaaatcattgtccgttcaattcggactcagaacgctattgtaatctgcatgcacatgaatgacgaacatcggaaagcgtatgagggaaaacctcacgtacggtttgatgaggaggggcagaatttatctgtcctttactctagcagaggcgcagtgaagacggcgggatacaaaactatgctggctgccatccgggcggacgctgcggccagcttccagccgggcagtcatcaggtgttccaaccgagtatccaacggatttcctagcagaatatccagctgacatccagtcacgtttccagccaggcttccagaaattcgtcaggtaatcatgttaagttatcgcaaagcgcaaggattcggagcaccgacagagaatgtatacagggaagatctcccaaatcggccggcaccccgcctgaatgtcgacacgcgtcgaattcctcgattgatggcaagccattcccagcgtttcttctccattcgctctttttaggcaaaatattaacaccttatgttagacagaccaaatttaactaaaattttactatacattcttcggaattttgatataattttacctaggttaccttaccaattatgatagaaaatagaattggatggtttttatacctatccaagctgtgtgcgagagaccagtccactggctacccagcaagccggcatgcggagaccgaaaattgtggaaaatgacagccgagaatatgttgctccatgacttcagaaggttcagaaaggatgaagccggggcgaagcggatgacggagatcagcttcgagaacgggctcatcatttgaaagagccggcagaggagaccgcgtgctgaagatcatgcctccgctgaccgtctcgatggagcatctggccgccggctgcgacattatcaagtccagtatgcagcaggtgatctctcaggagacccaggatttgctggtaagctcggccaagccggtggccgccccggcaagaggcacggaagtgcctttcgggggccgtgcggccctgatgttaagataacgttttcaccccattggaagattttctccccatgctgcctgcggtaccgtcaggcagcatggaattcaccgccaatccaagggctgtcacgttcatgccatacggagcattctttgagcctcatgcagcaccatcgtcacatctaatcgtcaggaaaagctcactaccccgcagccggatttttacttatccacaccaggcgggggaatatacaaatcgtacatagactgtatcaatatcccttaaatataggctacgacaaaggcaactccggtgccgaattcggaggtaaggccgacttcctgctggccggccggaaccctacagcaagccttacatcgatgggatgggtggaacatcccttgtcccccccccaaatctaattccgaacccaatgttaaaccacagcccgtcttggggcggctcgtccgcagcaagcatattgaagcagaggagccggaagcagctgcatctcttgcgtagaacgatgctctttgttttctttcacgcaggggagccgagcgggacagcttctaggcagaggattgccgcatgcgattaaacgggcaggcgaagcggtgacctggcgaaagccattgacattgttgtcacatgtttgaaaaggcggggagcgaggctggagcgttgctgcggcatatgttccgccggattgcttttaccgatgaagagaggggaacgatccagatggcttttgaaaaagaaacgttgttttggaacgaaaaatttggtaacgacgattataccttgacgcggctgccttacagcaaagctccaagctccctggcgcccattatgacaaccgtcggcggttcgctttcggaggaagcggcgcagcgcgtccttcaaatgagcaagggcgctccgctggccgcttttatgattttgctcgccggtgttcagtcgctcttgcataaatatacaggcgcttctgacattctggtcggcatgccggttgtacggaaaccgacggagacgcgccgatccgttaatcatacggtcattttgaaaaactcgctttcggcgggtgcgacttttaaaacgcttctgaacgagctgaggacttccttgccgagagcgattcagcatcaacatattccgttcttgaaaatgacggagaagctggacctgcaatatgcagacgggatacccgtcgtccatacgctagtatcccttaaggagctgcatctggacgaaatcgggcaaaacgtggtcacggattgttcctttgaattcagcttaaccggcgggacgatacagctagcgctgtcatataacgagcacttatatgactccgagttcatgactcgggtcgtcggccatctgaatcgcctgctggtcgtggggcttcacgagttggagctggacatcgtgcgggcggacatgctgtcggaagacgagaaatttcaattgctgcaaagctttaacgataccgagaaggactatccccgtgatcggacaattcatcagctcgtggaggagcaggcgaagcgggtgcccgaagcgacggcggttgtctttgaggggcggcggctttcgtacgcggagctgaacgaacgggcgaaccggctggcgcggacgttgcgatcgatcggcgtgctgcccaatcagctggtaggcttgatggtcagaagatcgttggagacggtcgttggcattctggcggttctgaaagctggcggtgcctacgtgccgatcgacccggaatacccggaagaacgcatccgctacattttggagaactcgaacgcgcagctgctgctgactcaaagggagctgctgcagctgcaggtgccgttcgaagggaccgtggtggcgctggatgacgagcaggcctacagcgacgatggctcgaacctggagccggccagcggtccgaacgatctggcttatgtcatctatacgtcaggtacgacgggcaatcccaaaggggtcatgctggagcatcacggtttggtcagcttgaagctgatgttcgcggacaggctgggcatcacggagcatgaccggatcgttcaattcgccagcctgtcgttcgacgcgtcctgctgggaagtgttcaaagcgctctattttggcgcggctttgtacatcccgacggccgagacgattctcgacaaccgcctgttcgagagttatatgaacgagcatgcgattacggcggcgattttgcctccgacgtacagtgcttatttgaacccggaccgccttcccagcttaacgaagctcgtaacgggaggctcggcggtatcggccgaattcgtgcagcagtggaaacgcaaggtccactatttcaatgcttacggccctaccgaagcttcgattgttacgacgctttgggatgcggatgaggagcagccggagggcagagtcattccgatcgggcgcccgctggccaatcaccggatttttattttggatgcccacctgcagcttgtgcctccgggagtggacggcgagctgtgcgtggcaggcgtggggcttgcgagaggttacctgaaccatccggagctgacggcagagaagttcgtggaacatccgtttgcgccgggagaacgcctttaccggacgggagatctcgcccgctggctgccggacggaaatgttgagtacttgggccggatcgaccatcaggtgaaaatccgtggattccggatcgagatcggcgagattgaagagcagcttctgaagatcgactccgtgcaggagacgatcgtaatcgcgcgggaaggcaaaagcgggcaagaactgtgcgcttacctggtcgcgggccgcccgcttacgctcggcgagctaagaagcgcgctggcgcaaaaattgccgaattacatgattccggcgcattttgttcagcttccgcagatgccgctcacgccgaacgacaaaatcgaccgcaaggctttgcccgctccggaaggaaacgcgctgaccggcggcgcgtacgtagctccccgcaatgaagccgagcggacgcttgccgatgtgtggcaggcggtattgaacgccgatcgcgttggggtaacggatcatttcttcgagctgggcggagactcgatcaagtccattcaagtatcttcgcggcttcatcaagccgggtacaagctggaaatccgggatttgttcaaatatccgactatttcacagctcagcctgcatgtgaaaccgatcggacgtaccattgatcaaggcgaaataacgggtgaaacggcgctgacgccgattcagcattggtttttcgagagctcctttgcggacccgcatcatttcaaccagtcggtgatgctgtaccggaaggagcgcttcgacgaagagacggtgcgtcaggtgctgcaaaagctggccgagcatcatgacgccttgcggatggtgttccgcaagacggaacaagggtttagcgcgcggaaccgcgcgattcaggacggcgggttgttcacgctggacgtgttcgacttcaaggatgcggagaataccgagcaggctgtggaagcgaaggcaacggacattcaagcgggcatcgatctggagaacgggctcctcttgaaggcgggactgttccggtgcgcggacggagatcatttgctgctcgcggttcatcatgccgtggtggatggcgtgtcttggcgcattttgatggaggatttcgctctgggttacgagcaggccggcaaaagcgaggaaattcgtttcccggcgaaaacggatgcgtaccgcacttggtccgaacagctggccgcttacgcgcaaagcccggaaatgacgaaggaacgggcctattggcaggccatggaacaaattgcggttccggcggtgccgaaggatctggatgtggacgttacgacgcagcaggacagcgaatcgctgttcgtccgtttgactcccgaagaaacggagctgctgctgaagcgggttcaccgggcctacaacaccgaaatgaacgatattttggtaacggcgctcggcatagccattcgcaagtggacgggacacgaacgggtgcggatcaatctcgaaggacacggacgcgaatcgatcggaacggatatcgacatcacgcgcacagtcggctggtttacgaccaagtttccggtcgtcctggagccggaaaccgaccgggatttggcctatcagattaaacaggtcaaggaaagcttgcgccgcattccgaacaaggggcttgggtacggcgtatgccgctatctctccaaatcggaggatggctttgtttggggcgcagagccggaaattaattttaactacctcggccagttcgacgatgatgtcagtcaggtcgagatcggcatatcttcttattccagcggcagcccggccagcgaccggcaggcccgcagctttgtgctggatatcaacggcatggtgctggacggcgctttatcgctcgatctcagctacagccggaagcagtatcgcaaggaaacgatggaagccttcgctcagcggcttgagcaaagtctgcgagagctcattacccactgcgcaggcaaagaaaacaccgaattgacgccgagcgacgtgcaatttaaaggcttgaccatcgcggaattggagcaaatcgcccagcgctcgggccatctcggggaaatcgaaaatatttactcgcttacgccgatgcagaagggcatgtggttccacagcgcgcttgaccggcaaactgccgcttacttcgagcagacgcggtttacgatgcggggagcgctcgacgtccagcttttcgagaggagctggatggagcttgcgaaacgtcatctggtgctgcgggcgaattttgtgaaaggaccggagggcgagccgctgcaagtcatataccgcgacaagccggtcggctttgaatatgaagagctgcttcatttgcaggcggacgagaaacaagcgtatttggataaaaaggccgaggatgacaagcttcgcggcttcgacatggaacatgacgcgctcgttcgggttacgatcttgcgcaccgaagagcaaagctatcatgtgctgtggagtttccagcatattttgatggacggctggtgcctgccgcagctgacgcaggagctgtttgagatgtactcggccttggcatccggcaagcagccagcgggagataagggatcggattatggcgcttatatcgaatggttggagaaacaggacgatcaggcggcatccggctattggacggcattcctggcagattatgaagggcaaaccgtactcccgggacaaaaggaaccggcgccaagcggcatatttacggctgatcacgtcaccgccgagctgggcaaggacttgagcgagcggatggaccgggtggcgaaacagcgcctggttacggtcaatacgctgctgcaagccgcttggggcgtgatgctgcaaaaatataacggaacaaacgatgccgtattcggcagcgtcgtggccggaagaccggcggaaatcccgggcattgagtccatgatcgggctgttcatcaatacggtgccggtccgcgtcacgagcgaagcggacaccgtgttcgccgacctgatggcgaagctccaagagcgggcgctggagtccgggcgatatgattactatccgctgtatgaaattcaagcccgcagcgtgcaaaagcagaacctgatcaaccatatcatcgctttcgagaactatccggtggacgagcagatggagcaggcgggcgaccagcagcacggcgacctgacgatcgctgacgttcagatggaggagcagacgaactataacttcaacgtgaccgtggtgccgggagtcgagatcgaaattcggttcgactttaacgctgaagtgttcgataaagacagcatcgagcggctcaagggacacctcgtccatctgctggagcaggtgacggataacccggaaattacagtgggcgagctggaacttgtgacggagggggaaaaggccgaccttctcggacgttttaacgacaccaccacggaatttccgcgcgggaagacgctcgttcaattgttcgaagaacaggcggagctttacccggacaacgtggccgccgtcatgaacgagcggcaactgacctaccgcgagctgaacgagcgatccaaccgccttgcgcggaagctgcgagagacgggagtagaagcggaccagctggtagcgattctggccgaacgctcgctcgatatggtcgtcggcattctggccattctcaaagcgggcggagcctacgtacctgtcgatcccgactacccggaggagcgcatccgcttcatgatcgaggattcgggcgcgccgttattgctgattcaaaagcatctgcacgagaagaccgacttcgcaggaacgcgcctcgaattggacgatttcgtttggggcgacagaggggcggactccgccgatgcgttggacgcttcgaacctggagccgatttccgggccgggcaacctggcatatgtcatctacacgtcgggaacgaccggcagaccgaaaggaacgctgatcgagcataagaacgtcgtgcggctcctgttcaacgacaagaacctgttcgacttcgggccgtccgacacgtggacgctgttccactcgttctgcttcgatttctccgtctgggaaatgtacggagcgctgctgtacggaggcaagctggtcatcgtaccgtcgctcacggcgaaaaatccggccgatttcctggcgttgctgggccgcgaacaggtcacgattttgaaccagacgccaacatacttctaccagctgctgcgtgaggtcttggcggaccatccgtacgatctgcggattcgcaacgtcatctttgggggcgaagcgctgagtccgctgctgctcaagggcttcaagacgaagtacccggagacgaagctgatcaatatgtacggcattaccgagacgacggttcacgtgacgtataaggaaatcacgtgggtcgaaatggaggcggcgaagagcaatatcggcaagccgatcccgacgttgagggtgtacgtcctagatgaaaaccgccgccctgtgccgatcggcgtagcgggcgaaatgtacgtggccggggaaggccttgcgagaggatacctgaaccgtccggatctgacggcggagaagttcgttgattccccgtttgcggagggggagaaactgtaccgttcgggcgacttggcggcttggctgccggacggcaacatcgaatacctgggccggatcgaccaccaggtcaaaatccgtgggtaccggatcgagctggacgaaatcgagacgcagcttctgaacgtccggggtgtggaagaagcggtggtgctcgcccgtcaggacggcgggggcgagaaggcgcttgtcgcctactttgtggcggaccggacgctgacggtcagcgaaatgagaacctcgctggcccagggaatgccggggtacatgatcccgtcgtacttcgtgcagttggagcgcatgccgctgacgaccaacggcaaagtggaccgcaaagcgctgccggagccgcaaggcggcatacaaacgggtgtcgaatacgtagcgccgcgtaactggacggagtcccagcttgtgaagatctgggaggaagtgctgggctactccggcattggagtcctggacaatttcttcgagctcggaggccactccttgcgggcgacgaaccttgtcagcaagattcagaaggaaatgaacgtcgagctgcctctgcgcgacgtattccgctattcgacgatcgaagagatggctcttgccatctcccggatcggagagcagtcgttctcgtcgattccgctggcaggcgcaagagcatattatccgctttcctcagctcagaagcggctgtttatcctgaatcagctggaaggggccgatcagagctacaacatgccgggggtgctgctgctggaaggatcgattgaccggagcctgctggagaaggctttccgcggactgatcgcacggcacgaaacgctgcgaaccggctttgagattgtacaaggcgaagcaatacagcgcatttacgagagcgtcgactttgccgtcgagtaccgtcatgcgagcgaggaagaagcgcctgaagtcgtgcaggccttcatccggcctttcgacttggcgaagcccccgttgctgcgggcggagctcgtagagctggcagccgaacgttacttgctgatgttcgacatgcaccatatcgtctccgacggggtttcgatggacgtgttagtcgaggaactcgttcgtctgtacggcggcgagtcattagagcctttgcgcattcaatacaaggactatgcggtatggcagcagtcggacgagcaaaaagtgcagttgaaacgcgaggaagcttactggctggaccgttaccggggcgagctgccggttctggaaatgccgacggactatccgcgtcctgccgtgcagagctttgagggacaaacgctgacgtccttcgtggacgaggcaacgaacgaaggcttgaagcagctggccgctcaaagaggaacgacgctgtatatggtgctgcttgcggcatataccgtgcttttgcataaatacacaggtcaggacgatttgatcgtcggaacgtcgattgcgggcagaacgcacggagacacgcagcctttgatcggaatgttcgtcaatacgctggcgctccgcaattatccggcttcgaagaagaccttcctgtcgtatctggaagaagtgaaagaaacgactttaggcgcttacgagcatcagaattatccgttcgaagagctcgttgataaagtgcaggtcagccgggatttgagccgcaacccgctgtttgacacgatgttctccctgcaaaacttggaggataaagagtttgagctggaagggctgaaattgtcctcgtaccctagcgaatacggcacggccaagttcgacctgagtgtggatgttacggaagaaaacggcggcctggagtgcagctttgaattcgcaacggctctttataaagaaagcacgatccggcggctgtcgactcatttcggacatttgcttgcggcgatcgcaagccgtccggatgcgaagattgccgagctgaacttgctgacggcagaggaaaaagagcaaattctcggcgcgttcaacccggcgcagctggaagcggctcctgcggccgcgttccaccggctgtttgaggaacaggtggagcgcacgccggaagaggcggccgtcgtgtacgagaatgagcggctgacgtatgcggagctgaacgagcgggcgaaccgcttggcggctacgctgcgcgcaagcggcatcggccgggagacgatcgtcggcattctcgccgagcgttcggtggacttgctggtggccgtgctggccgtctggaaagcgggcggggcgtatgtgccgctcgacccggattatccggcagaccgcgtgcggttcatgcttgaagacagcggagcgaaggtgctgctgacgcaaacggcgctgcgagagcgtgccgaagcctggctcggcgaagaggagctggcgctggcggcggtgctgtacctggacgacgaagcgtcgtacaacgaggagcgggcgaatgcgccggttggctccggcatggtctccggcaagctgacggatgctgtggacgacggcgatgagagccatcagaatgtcgacaccgacggcttccatgaagcccgtccagaggacctggcgtacgtgatctacacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgttcgacgtgttcgtgggagatatcgcgcggacgctgtacaacggaggtacgatggtgattgtgccgaaggacgatcggattgatccgtctcgtctgcaccactggatggagcgggagcgggtcaccatcttcgaatcgacgccggcgctgatcgtgccattcctggagtacgtgcacgagcagcggctggatatgagctggatggagctgttgatcacgagctcggacagctgcagcgtggcggattaccggaccttgcaggaacgcttcggctcgttgttccggatcatcaacgcctacggcgtgacggaagcggcgatcgactccagcttctacgacgaggagctgacgaagctgccgcagacaggtcatgtgccgatcggcaaagcgtggctgaatgcgaaattctacatcgtggacgcgcatctgaacccggtgccggtcggggtgctgggcgagctggtcatcggcggagtcggagtggcgcgcgggtacttgaaccgtccggagctgacggaagagaagttcgtagacagtccgttcgccgcgggcgagcggctgtaccgcacgggagacttggcgcggtggatggaggacgggaacgtggacttcatcggccggatcgacaaccaggcgaaaatccgggggtaccggatcgagacgggcgagatcgagtcgcagctgctgcgggtggaaggcgtgcgcgaagcagtggtgctggttcgaagtgacgcgaacgggcagaaggcgctatgcgcgtattacacgccggataccggagcggagctggcggtgaacgatttgcgcggcgcgctggcgcaggagctgccgggctacatgatcccgtcgtacttcgtggagctggagcgtctacctctgacgccgaacggaaagattgaccggaaggcgctgccggcgccggaaagggaagcgggaagcggaacggagtacgtcgcaccgcgcaatgagctggaaacgaagctgacggcgatttggcaggaggtgctggggcttgcgaaggagattggcgttcacgacaacttcttcgacatcggcggccactccctgcgagcgacgacgctggtcagcaagattcataaagagttgaacgtggatctgccgctgcgcgacgtgttccgccattccactatcgagagcatggcggccgccatttcccggctggatgagcagacattcgttgccattccggtggcggatgaccgagaggtgtacccgcaatcttttgctcaaaaacgtctctttatcctgaatcaactggaaggcgcagagcttagctacaacatgccggaagcgatgctgctggagggtgctttggaccggacaaggttcgaagaagcgttccgtaagctcgtggcgcggcatgaaacgctgcgcaccgggttcgaaatggtggatggcgaagcatcgcagcggatttaccaggacgtgaattttgccgtggagttctatcgagtggatgagcaagaggccgaagagacggttcaccgtttcgtccgtccgtttgacttggcgaagcctccgctgctgagggtaggccttgtcgagctggctccggaacgccatattctaatgtacgacatgcatcatattatttccgacggcgtctcgatggaaatctttgttgaagaattcgtccgcttgtacggcggcgagcaattggagcctctgcgcattcagtacaaagactacaccgtttggcagcattcacaggagcagaaagaacggcttcagcgtcaggaggcgtactggctggacatgttccaaggcgagcttccggtgctggaaatgccgaccgactatccgcgtccggccgtgcagagctacgaaggccaaacgctggagtttttcttcgacgcttcgaaaaccgacggcctgaagcagctggcctcggaaacgggcacgacgctgtttatggtgctgcttgcggcgtataacgtccttctgcataaatattcaggtcaggaagacgtgatcgtcggtacgccgattgccggaaggaatcatggagatgtgcagccgttgatcgggattttcttaaacacgctggctatccgcagttatccggcttcggagaagacattcctgtcatacctgaacgaagtcaaagaaacgaccctccacgccttcgagcatcaaaactatccgttcgaagaattggtggacaaggtgcaagtcacccgtgatttaagccgcaatccactcttcgacacgctgtttacgatgcagaatacggagaacgaggaatttgagctggaagggcttcgcctgattccttatccgagcgcactggataccgcgaagtttgatatcagcttggatgtgggcgaggagaacggcggcttggattacagcttcgaatatgcgacggctctctacaaaagggagacgatcgaacggctggcgaaacattacgagcagctgctcgtaacgatcgtaagccgtccggatgcgaagatcgccgagctgaacttgctgacggcagaggaaaaaggacaaattctcggcgcgttccacccggcgcagctggaagcggctcctgcggccgcgttccaccggctgttcgaggaacaggcggagcgcacgccggaagcggtagccgtcgtgtacgagaatgaccggctgacgtatgcggagctgaacgagcgggcgaaccgcttggcggctacgctgcgcgcaagcggcatcggccgggagacgatcgtcggcattctggccgagcgttcggtggacttgctagtggccgtgctggccgtctggaaagcgggcggggcgtatgtgccgctcgacccggattatccggcagagcgcgtgcggttcatgctcgaagacagcggagcgaaggtgctgctgacgcaaacgccgctgcgagagcgtgccaaagcctggctcggcgaagaggagctggcgctggcggcggtgctgtacctggacgacgaagcgtcgtacagcgaggagcgggcgaatgccgacagcttccatgaagcccgtccagaggacctggcgtacgtgatctatacgtcgggaacgacgggcaagccgaagggcgtgatgatcgagcaccgcagcctggtgaacacggcggcgagctaccggcgggaataccggttggatcagttcccggtgcggctgctgcaactcgccagcttctcgttcgacgtgttcgtgggagatatcgcgcggacgctgtataacggaggtacgatggtgatcgtgccgaaggacgaccggatcgatccgtctcgtctgcactactggatggagcgggagcaagtgacgatctttgaatcaacgccggcgctgatcgtgccgtttatggaatacgtgcacgagcaagggctggatatgagctggatggaactgttgatcacgagctcggacagctgcagcgtggcggattaccggaccttgcaggaacgcttcggctcgttgttccggatcatcaacgcctacggcgtgacggaagcggcgatcgactccagcttctacgacgaggagctggcgaagctgccgcagacaggccatgtgccgatcggcaaagcgtggctgaatgcgaaattctacatcgtggacgcgcatctgaacccggtgccggtcggggtgctgggcgagctggtcatcggcggagtcggagtggcgcgcgggtacttgaaccgtccggaactgacgggagagaagttcgtagacagcccgttcgccgcgggcgagcggctgtaccgcacgggagacttggcgcggtggatggaggacgggaacgtggacttcatcggccggatcgacaaccaggcgaaaatccggggctaccggattgagacgggcgagatcgagtcgcagctactgcaggtggaaggcgtgcgcgaagcggtggtgctggttcgaagtgacgcgaacgggcagaaggcgctatgcgcgtattacacgccggataccggagcggagctggcggtgaacgatttgcgcggcgcgctggcgcaggagctgccgggctacatgatcccgtcgtacttcgtggagatggagcgcctgcctctgacgccgaacggaaagattgaccggaaggcgctgccggcgccggaaggggaagcgggaagcggaacggagtacgtcgcaccgcgcaatgagctggaaacgaagctgacggcgatttggcaggaggtgctggggcttgcgaaggagattggcgttcacgacaacttcttcgacatcggcggccactccctgcgagcgacgacgctggcgggcaaggtatttaaggaattaaacgtcaacctgccgctgcgcgacgtattccgtcactcgacgattgcggcgatggccgaggcgatcgcccggatggaacggcgggagcatgaggccattcctcaagcggaggagagagagtactaccctctgtcctccgcgcagaaacggctgttcattcagcacacgctggatggagcggatcagctttacaacatgccggagctggtgcaggtggaaggcgagtttgatttagaacggttggaagccgccttgcggaaattgataacacggcatgaatcgctgcgcaccggttttgaaatcgtgaagggcgaagcggttcagcggatttacccgcaggtcgattttgctatcgagcattatcaagcggataaagaggatgcggctcaaatcgagcagatcgtccgcagcttcgttcgtccgtttgatctcggcaagccgccgctgctgcgcgccggggtcatcgagctggagccgaacctgcatattctccttttcgacatgcaccatatggtgtccgacggcgtatcgatggcgattgtgatcgatgagttctcgagtttctacgccggggaagaactgccgccactgcgcattcaatacaaggattatgccgtttggcagcagtcgaaggcccaccgagagcggatcgggcggcaggaagcgtactggctgcaaaccttcgaaggcgagctgccgacggcagacctgccgatggactacgaacggtctgcggctcgcagctacgaaggcgcgcatctggagttcgacgtcgaagcttctctctctgcgcagctgcgcgaattggcggccgagcgtgaaagcacgctgttcatggtgctgcttgcggcttataccgtgctgctgtccaagtacagcgggcaggaggacttggtcgtgggcaccccggtggcgggaagaacgaacgccgatttggaaccgatcatcgggatgtttgtcaatacgctggcgatccgcaatcgtccgtcgggcgacaaaacgttcttgtcctacctggaagaagtgaaggaaacggctttgggtgctttcgagaaccaggattatccattcgaggagcttgtggagcgtttgaatgtgaagcgggaaccgggccgcttcccgctgttcgatgccgttttcgacttgcaaaatatcgaagaacgagacgccgagctggaaggggtcagcctgaagacttacgagcttgaccatttggaagaagcgaagttcgatctgacgctgtttatgtatgaaaacaatggggcgctgagcgggggcttcttctacgccaccaagctgttcaaagaagcgatgatccgcaccttgaccgaggattacctgcgggtactgtctcaaattgcgaaaaatccacaactcgagctaagccggatagaatgtcataaaccggcggcaggcgcaaagagtgccgtcgatacgatcgaattcgcgttctaattctacaagcgcgcctccgccgtcaaacgaaagcggcgcgcatcccaaggaagacggcgaacaacgcccaagcccgtaaacacgcaggccgaaagcaagctttttcggacctgcgccggggcatgcggtcacttcatttttaggggaggtacaaatgaaatctttgtttgaaaaggaagaacagtactggagcggtaagtttgacgccgatgacagcctgagcttccttccctacagtcaatcctccaaattatccgcccacggggaagctgcggccgagccgggcttgcttcaccgtactctgccgagtcaactctcggagagaatcattagcctcgccaacggttcggatttggctttgtacatgattgttttggcaggagtaaaaagcctgctgttcaaatataccgggcgggaccaagtgctggtcggcatgccttcttatagcgcagaccccgacgggactccgccgccgcatgacatcttggtgatcaagacgtccgtaagccgccagactacgctgaaaacgctgctcgggggcatcaaagcctccatcggcgaggcgctggagcatcagcacctgccttttcggaaaatggtggagccactccatctggactatacgggggacggcctcccggtcgttaacaccgtcgtatccttcgccccgattcatccggaaccgcaaggtaatcgggtggcggccgatacggtttttcgcttcgaccgccaaaaccactccatcgagctggaaataagctttgacgggcagcggtacgagcgggcatttgtggaacaggcggccgaccatcttgttcggctgctgtccgtgcttttatttcagccggatctgaagctgggacaagccgatgtgctgtcaccagacgagagggagacgctgctgaaacgatttaatgacaccgaaaccgagttcgagcgggggaaaacgatttacggcttgttcgaagagcaggcggagctttacccggacaacgtggccgccgtcatgaacgagcggcagctgacctaccgcgagctgaacgagcgatccaaccgccttgcgcggaagctgcgtgaggcgggagtagaagcggaccagctggtagcgattctggccgaacgctcgctcgatatggtcgtcggcattctggcgattctcaaagcgggcggagcatacgtgcctgtcgatcccgactacccggaggagcgtatccgcttcatgatcgaggattcgggcgcgccgttattgctgattcaaaagcatctgcacgagaagaccgacttcgcaggaacgcgcctcgaattggacgatttcgtttggggcgacagaggggcgaactccgccgaagcgctggacgcttcgaacctggagccgatttccgggccgggcaacctggcatatgtcatctacacgtcgggaacgaccggcagaccgaaaggaacgctgatcgagcataagaacgtcgtgcggctcctgttcaacgacaagaatctgtttgacttcgggccgtccgacacgtggacgctgttccactcgttctgcttcgatttctccgtctgggaaatgtacggagcgctgctgtacggaggcaagctggtcatcgtaccgccgctcacggcgaaaaatccggccgatttcctggcgctgctgggccgcgaacaggttaccattttgaaccagacgccaacgtacttctaccagctgctgcgtaaggtcttggcggaccatccgtacgatctgcggattcgcaacgtcatcttcgggggcgaagcgctgagtccgctgttgctcaagggcttcaagacgaagtacccggagacgaagctgattaatatgtacggcattaccgagacgacggttcacgtgacgtataaggaaatcacgtgggtcgaaatggaggcggcgaagagcaatatcggcaagccgatcccgacgttgagggtgtacgtcctggatgaaaaccgccgccttgtgccgatcggcgtagcgggcgaaatgtacgtggccggggaaggccttgcgagaggatacctgaaccgtccggatctgacggcggagaagttcgtcgattccccgtttgcggagggggagagactataccgctcgggcgacttggcggcttggctgccggacggcaacatcgaatacctgggccggatcgaccaccaggtcaaaatccgcgggtaccggatcgagctggacgaaatcgagacgcagcttctgaacgcccggggcgtggaagaagcggtggtgctcgcccgcgacgacgcgcacggccataagcagcttgtcgcttattacgtcgcggaaacgaggctggcggcgaatgaactcaaggaggagctcgccaagcagcttccagggtatatgattccttcgcacctcgtgcagctttcgcggatgccgctgaccccgaacgggaaaatcgaccgcaaagcgctgcccgcgccggaggaagccgcggccggaggagcggaatatgtcgcgccgagaacgctgctcgaaatgaagatcgtccgcgtctggcaggatacgcttggcgttccgcaggtcggcgtaaaggataacttttttgagttgggtggcaattcgttaagtctgatgaggctcgttcaagccgtttacgatgaaacgggcattgagataccactgaaccgccaattccataatgtaacagttgaagccatggctttcggagagggggatctgggcctggataaagggggagactccttcattaagctgaataaagcaggagatctgaacgtgttctgcttccctccgggcagcggcttcggcatcggttaccgggagctcgcaagcaggctcgacggccggttcgtgctctacggcattgattttatcgacgatgccgccgattacgaagccatgctgaaccgttatgtggacgagatcgtccgcatccagccggaaggaccttacgtgctgctcggctactgctttggaggcaacctgatgttcgaggtagccaaaacgatggagaaaagagagtattccgtaacggacgtgctcatggtggactcgtggattaaggacacgctgacgccttccgaaacgtcggagaaagagcttgaagaaacgcttgccgatttcgacgaagaagagaaggaattaatgagcaacccgctcgtgcgggagcgtgttcatcggaaggtcaaagcgaccttggcgtacgaagcgcagcttatgaattccggcacgatcccggccaggatttacgaactgattgcgaaggacagcgaagcgttccgcctggagcaccaattgccgtcctggcggggggcaacgacgcaagcttacgccgattaccggctggagggcgcgcacgaggaattgctggaactcgcgcgcgtggacgaaacggccgttgtcatccgggacatcttagaacaagtcaagcggcagatcgaagcggaggccggggtactgcatggaagctgaccggcagccgtctgttcaagaacaaggcgcagcggcgccttccaagcgccaaaccgcttacgccgcctggaaagcgttccgctggctgatgtcctatgtaagccgtcacaaaggctggatgatcgtcggtaccttgtccgcgattgccgccgccgttattgagatatggacgggaagtttgatcgagcagctgaccacccaggccgagaagggggcggggccaatcgttctgcaaatcgtgtacacggtctttgtggtcatcttgatcggtgtgccggcgaagtttttcatgagcttcggcgtggagcgaagcagcgcctctgcggtgcaggatatccgcaaccgtctcatgcgtcatatcggcaaactcccgatctcctatttggaaaagcagcactccggcgacgtattgtcgcggatcaacaacgacctgcagctcatccagcagtttatgattcgggacctcgcccagtggttttatcatccgctgttgttcatcggctgtttcgcttatttgatctacctccaatgggagctgatgctgtacagcttgctgttatttcccgtagcgctgctggtttcccaatggatcggcaagcagttggagcggttgacggaggaagcccaggcgaacatgggccgaatgaacgtcaacctccaggatacgcttgggggtatgcctattgtaaaaagctacctgctatccggcatgttatctcgctcctaccaagcgctgctgcaattgacggctcaaaaaaagctggccgtgaaaaagcgagaagcctgggtcaacccgctgctttccacgctgatgatcagcccgatcattttcgccgtcagttacggaagttatttgatctacaaagggcagctaggcgcgggagaactgatcgccttcctgtacttgctgaatctgtgtctggagccgctggagcatattcccgagctcatcacgcggacgttcgaaatggccggtgccctgagaagggtctccgaaatcgtcgagcagccgaccgaaacggaaaatggccgttcgcttccgaaagcgagcgccgcccccatcgagtttcagaacgtaaccttcgggtatgaggagaaatccccgatcctgcggaatgttagcttctcggtgccggaagggaagacgatcgcgcttgtcggagcgagcggcggagggaagagcacggtgtttaagcttgtatgcggtttttatccgcttccggaggaccagggcgagatccgcgtgttcggcagcctgatccacggcgccgatccggagcagcttcggtcgcatttttccgtggtaacccaggattcatatttgtttagcggcacgatcgctgaaaatatcggctacgggcgggaagtagcgtcgatggacgagattatcgaagccgccaaagccgctcaggcgcattccttcattatgcagcttcccgacggctaccagacgtatgtcggagagcgcggaggctttttgtccggcgggcagcgccagcgcattgcaatggcccgagcttttctgaaggatgcttccgttctgctgctggacgagccaacgtcggctcttgatccggagtcggaaaacgcggttcaggaagccctgggcgtattgatgaagcagagaacgacgatggttattgcccaccggctttctacagtacaaaacgccgacgaaatttgggtcatggaacaggggagtattgttgaaaagggcactcatgaacaattgctgaagatgaagggactgtacgcccagtcgtactatcaggaatttaccgagtctgccgaacgcagggaggtggcgtacacatgaaaaagggcggatggctctcgcaagtgaaagaactcggctacttgctgatgtttatgaaccgcaagcgcaaaacccagtacgccattggcctggccgtgacggcgctcacccagacattgttcctgatcgccttcagcttggtcgtacataacttggttgatttcgctgtgtcccgagatacgtccctgatggtggaagcctttattattttgggcgcggccttgttcctggaaaatgtgatttctccctggttcatttacttataccagcgcagtgtcgagctgactgtgctgaatatccgcgaacgtctttatgacaagctgtgccgggtgcggccgagattcctggagcagacgcaccatggggacttgctgtcgcgagtgaacaacgacgtaacgaccgttgagtttacattctcgcaggtttacttcgttttgctgcttcaagttgtcttttgtatcggctccattgtctccatggtgttgatcgattggcgttttgccggcgtatccttcgtcattctgctgctgtcctccgtggtcagcctgaaatttgcgcgggatattcgcgccttgtccgaacaaggcttgcaaacgctcggtaaaatgaccgaaaaattcaaagattttatgggcggcattcaaattgtgaagctgttccgcatccgcacgatttatggccagtacgaggcgttgaacgaacaaatgacgcagacgcttcggcaaaccgcgcagaagaacggcatgcaggctgcggtgaatcattttatcagctacgtcacgttctgcggcatcatcgtcatcggcagtcttctttatgcccacggactgatgggaatgggaagcgttgccgccctggcggttctgcaagtgaatctgacgcacgccttgttgaacttggggatggttctgtcgatgacccaaaattcgctcgcgggcgctcaccggattcaagaggtactaagagaggaagaggaaccggagcgtttgggatctcctcacagcgagctcgtgtcggaggctgcagtggagtttcgcgatgtggaattttcctatcaggcggataaaaaggtgcttgtcgacatctccatgcaggtgtttcccggccaggtcgccgctatcgtgggggccagcggcagcggcaaaagtacgctgatcaagctgctgctcggcttttatcctgtggacagcggagaaatcctactccaaggcaaaccgttcggccattacacgctggacgaaatccgcaggcagattgcatacgttccgcaggagccgttcttgtttaccggtacgattgaggaaaacatccgctacggcaacccggatgcaacggatgaagaagtgatcgaagcggccaaagcggcgtacgctcaccatttcattcaggaacttcctgaacagtataaaacgccggtgggagagagaggagcgtcgttgtcgggcggacaaaggcagcgaattgcgatcgcccgggcgattctcaaaaacgccccgattctgctgctggatgaagcgacttccgcgctggataacgaatcccagcattgggtacagcaggccttgaacgtattgatgaaggggcgcaccaccattctgatcgcccaccgtctcagcaccgtggaacatgcggatttgattaccgtcatgaaccaagggacggtcgtcgagcggggccgccatcaggacctgctggcgctcgggggttattacgcccggctgtacggctagacccgctttacggcgggcggcttcctgcttgcgaatgcgacagagtcttttagtaatccaaggtatgactttataaccggtagttaccagaaaacgtagacacgaaaaaggaggaagagtccgaaggagccgttccgggaatggcctgcgcggttcttctaagagtgactaagtgacatctaggtacaaagcctatctataaagaatctctaaaccgggagtgtgtcgatgtgagagagaataccaaagagcaatatggattaacgcaagcccagcgccgaatatggttcatggaaattatgaatccgggaacgtccatcacgatgctttccgcgacctaccagattacgggcgagatcaacacacagcttctggagcaagcggcagcagagatcgtcaaaacctatgacgttttccgaatccgcattagcggggatttgcaaaatccaacgcagtggttcgaagagccggagaatgtccaggctaggataagccgcctcgaaataggcacaaccgaacaattctatgcttgggtgaaagaagtaagcgaaaaaccggccagcgtgttcgacgaacacctccaccaatttacgattatccattttgtgaacggccaagtatggctcaatttgacggtaaatcatattatcgccgacggcttgtccgtcaatgctttgctgcatgcggtgatggaaaaatacctggaactgcgcaaaggcatctccagcagttaccaggccccttcctatctggattatatttccgcggagcgtgaatatgagcaatcgcagcgttatcaaaaaggcaaggaatactggctgacgaagtacaacactttgcctgaaacgaccggcattaaatcgtatccgccattctcgatcggcagcgaatccaataaactgtccatcactttggacggttcccggtatgaacgcattctgaccttcagcgaacaatatcaggtcagcttatatacgttatttctgtccgccatgtacgccttattgtacaagctgaccgacagcatcgatgttccggtcggcacggttttcgccaatcgcaccagcaagaaggaaaaagaaacgattggcatgttcgtcagcaccgtggctacgcggattcgtctgaatccagacaggaacgtgctttccttgatccaaacggtttccaaggaaaatacggcggatctgcggtatcagaaatacccttataaccaattgatccaggatttacgtgaacaacacggccgcaacgatctttcggggctgttccgcacgtctctggaatatctgcctttgaaaatcgtggagtacgaagaaatcaaggtacgcctggaggctcactttgctaggcacgagatggacgatttgctgctgcgcttcgaccatatgctgaatgaaggccatgtcattctccatgcttcctatcgtaccggcttgttcgagacggccgagattgatcggattatggaacagtatgtaaccgttctggaccagtttcttcagactcccgaactgccgatacgcgagatttctctgctgagcgatgaggagagacaccgcattctcaacgtttttaacccgccggtggcagggctgagcgagggagaagcgtttcatcggtatgttgaaaagtttgctcgagaaattccagatcatccggcagtcgtctacatggacaaacagctgacctacggcgaattgaacgaacgcgccgagcggctggcttctctccttcgcgaacagggcgtgggaaaggagacgattacggggatctgggcggagcgttcagtggaactgctggtcggggtgctcgccgtttggaaagccggcggagcctatgtaccgctggaccccgattatccggcggagcggattgagtacatgctcagcgatagcgatgcatcggtgctgcttacgcagcgtcatctgttggagcgggccggaggttggttggccgatgaccggctgaagcttcaagctgtctatgccatggacgatgaacagatttataacggggatgccttagccgtggaatttgaatctgccggcagcgccccgcaagacttggcttatgtgatttacacctcgggtacgacgggacgcccgaaaggtgtcatgatcgagcatggtagtctcgtgaatacggcggatgcgtaccgtcgcgagtaccggttggatcagtttccggtgcggctgctgcagctggccagcttctcgtttgacgtgttcgtcggagacatcgcgcggacgctgtataacggaggcacgatggtgattgtgccgaaggatgaccggattgatccgaacctcttatacggctggattcgggaccaaaacattacggtattcgaatcgacgcctgcgctcatcctgccgttcatgcagcatatttatgaagaagggctggacgttagctccatgcagttgctgattaccagctcggatgcttgcagtgtcaccgattaccgattgctgcaggaaagattcggcggacaattccgcatcatcaacagctatggcgttaccgaagcggccattgacagcagcttttacggtgagccgctggataagctgccgccgtcgggtcatgtgccgatcggcaaagcttggctgaacgcccggttttacattgtcgatgccgcgttaaagccggttcctgtaggggttccgggcgagcttgtcatcggcggcgccggggtggcgcgcgggtactggaaccgtccagacctaaccgccgagaagtttgcggacagcccgtttgtgccgggcgaacgtctgtaccggacaggcgatttggcccgctggctggaagacggcaacgtcgacttcatcggccggatcgactatcaggtgaaaattcgcgggttccggatcgaactcggcgaaattgaaacggccctgctgcgtttcccgggcgtcaagcaggctgtggtgaccgaccgtacggatgagcagggggaaaagtatttgtgcggctacgtggcggcggatgcttccttgcagctgagcgatttgctgtcccaattgaagcaagagctgccggcccatatggtcccggcccggctggtgtctcttgataagcttccgctcacgccgaacggcaaaattgaccgtaaagcgctgcctgaaccgaccggagaggtagaagcaggccgtgagtatgtggctcctcgcacaacgctggaaacaagacttgctctcatttggcagcaggtgctgggtattgcgcgagttggagtccaagacgatttttttgacttgggtggtcattccttgcgggcctccacgctggtttccaagattcggaaagagctgcaagtcgaggttccgctgcgcgaagttttccgctacaccacgatcgaacagctggcccaaagaatcggcggtttaaggcagcaggagacgtatgagattacaaaggcggctgaggccgagtactatccggtttcatccgagcaaaagcgtctgtacgtcctgcgccagcttgacggggccgagcgcagctacaatatgtcggcggcgcttcttctcgaaggcaagctggaccgcatgcgcgtcgagcacgcgttccgggcgctgattcagcgccatgagacgctgcgtacgggaatcgagcaggttcaaggcgagcttgtccagcgcatctatgacgaggtcgagtttgctgtggattatttccaggcgagcgagcgggaagtggagcaagtggtggaagcttactatcacccgtttgatctgaccaagccgccacttctccgcatcggcctgatcgaagtcgccgaggatcgccacattctgctgttcgatatgcaccatatcgtctcggatggcatttcgacagcgctgctcttcgacgagttcagccgcctgtatcggggcgaggagctgggcccgctgcgcattcaatacaaagattatgccgtttggcagcattccgaagcttacgggcagatgctccagccgcagaaggagtattggctggaacagctgtcgggcgagctgccggtcttggagctaccgacggacttcccgcggcctgcggtgcaaagctttgacggtcgaaccgtgaagttttatatcgagaaagatcggacggagaagctgaaagagctggcggcacggacagggacgaccctgtacatggtgctgctgtcggcttacaccatccttatgcataaatattcgggtcaggaagatctgatcgtaggaacgccgattgccggaagaacgcaggaagaagtgcagccgatcgtagggatgtttatcaacacgctggccattcgcagccgtccggagcgttccaagccgtacctttcgtacctggaagaaatcaaggacatcacgctcggggctttcgaacaccaaaattatttgttcgaagacttggtggaaagtcttcatattccacgcgcgaccggccggaatccgctctttgacacgttcttctccctacaaaatacggagaacgagcaaattgtcatcgaggggctggagcaatcgttttatccgctggaaaaccaaacatccaagttcgagctgctcctggatatttcggagctggacggtcagctcgaatgccggttagagtacgctacggctttgtataaacaggagaccgcggagcggttcgccagacattatgacaagctgcttgaaaccatcgcagcagcgccggacggggatattgcctcgctggaaatgctcaaggaggaggaaatccgcgagctggtgcgcggtttcaacgattcggaggcggactacccgcggcagcagacgattcacggcttgttcgaagaacaggcggagctttacccggacaacgtggccgccgtcatgaacgagcggcaactgacctaccgcgagctgaacgagcgatccaaccgccttgcgcggaagctgcgagagacgggagtagaagcggaccagctggtagcgattctggccgaacgctcgctcgatatggtcgtcggcattctggcgattctcaaagcgggcggagcctacgtgcctgtcgatcccgactacccggaggagcgcatccgcttcatgatcgaggattcgggcgcgccgttattgctgattcaaaagcatctgcacgagaagaccgacttcgcaggaacgcgcctcgaattggacgatttcgtttggggcgacagaggggcgaactccgccgaagcgctggacgcttcgaacctggagccaatttccgggccgggcaacctggcatatgtcatctacacgtcgggaacgaccggcagaccgaaaggaacgctgatcgagcataagaacgtcgtgcggctcctgttcaacgacaagaacctgttcgacttcgggccgtccgacacgtggacgctgttccactcgttctgcttcgatttctccgtctgggaaatgtacggagcgctgctgtacggaggcaagctggtcatcgtaccgccgctcacggcgaaaaatccggccgatttcctggcgctgctgggccgcgaacaggttaccattttgaaccagacgccaacatacttctaccagctgctgcgtgaggtcttggcggaccatccgtacgatctgcggattcgcaacgtcatcttcgggggcgaagcgctgagtccgctgctgctcaagggcttcaagacgaagtacccggagacgaagctgatcaatatgtacggcattaccgagacgacggttcacgtgacgtataaggaaatcacgtgggtcgaaatggaggcggcgaagagcaatatcggcaagccgatcccgacgttgagggtgtacgtcctagatgaaaaccgccgccctgtgccgatcggcgtagcgggcgaaatgtacgtggccggggaaggccttgcgagaggatacctgaaccgtccggatctgacggcggagaagttcgttgattccccgtttgcggagggggagaaactgtaccgttcgggcgacttggcggcttggctgccggacggcaacatcgaatacctgggccggatcgaccaccaggtcaaaatccgtgggtaccggatcgagctggacgaaatcgagacgcagcttctgaacgtccggggtgtggaagaagcggtggtgctcgcccgtcaggacggcgggggcgagaaggcgcttgtcgcctactttgtggcggaccggacgctgacggtcagcgaaatgagaacctcgctggcccagggaatgccggggtacatgatcccgtcgtacttcgtgcagttggagcgcatgccgctgacgaccaacggcaaagtggaccgcaaagcgctgccggagccgcaaggcggcatacaaacgggtgtcgaatacgtagcgccgcgtaactggacggagtcccagcttgtgaagatctgggaggaagtgctgggttactccggcattggagtcctggacaatttcttcgagctcggaggccactccttgcgggcgacgaaccttgtcagcaagattcggaaggaaatgaacgtcgaacttccactgcgtgatgtgttccgctatacgacggtagagtcgatggccggggctattgccagcttggaagaaacacagcacagctcgattccgaaagcggaagagaaagcgtactatccggtttcctccgcgcaaaaaaggctgtacgtcctgcaccagctggatagctcggagctgaattacaacctcccaagcgccttgcaattggaaggggctttgaacgaggccaaagtggaaaaggcactgactactttggtggcccggcacgatatgctgcgcaccggttttgaaatcgtgaatggggagccggttcagcgtattcatccgctcgtagctttcaaggtcgagaagcttcaagcaagcgaagatcaggttgcggccattcttgaaggcttcattcagccttttgacttgacccagccgcctttgctgcgcgccctgctgatcgaactggagaaagagaaatttctgctcgcgctggatattcatcatattggttccgacggcctttccatggacgtgctgctgcgcgaattcgtgcggctttacaatggggaggaattgccggagctgcggattcaatacaaggattacgccgtttggcagcaatccgaggagcagcgccagcgcatcaaacggcaggaggaatactggcgcggggtattcagctccgagcttccggttcttgagctgcctctcgacttctcccgcccggccgttcagcagtttgacggtcaaacgctcacgtttacgctggatgcggagaaaagcgaagctctcaaacggcttgccggcgattcgggggcgacgctgtacatgcttctgctggctgcgtactccgtattgcttcataaatacgcgggacaggaagatatagtggtcggcactccgattgccgcccgttctcacgccgacctgcagccgattatcggcatgttcgtcaatacgctggcccttcgtttgcgtccggcggcggagcggacgttcctggattacttgcaggaagtgaaggaaacgacgcttggagcctacgagcaccaggactatccgttcgaggagttggtggaagctcttcaggtgagccgggatttaagccggaatcctctgtttgacaccatgttttctttgcaaaagcacgaaagcttggatttaaccctggaaggcttgcaatggtcgctgttcgacatcgaggaaaagacggccaagtttgatcttagctttgatatcgtggaagccgataacgagctggtttgcaagattgagtacgctacctcgttgtttagacaggaaacgatggtacggctggcgggacattatgagcagcttttggcgtccatcctggctcagccgggtgcgcggatttcggatttggatatcttgacggacagcgaaaagcatgatttgctggtcgggtttgacgtgtcgtcttcggctcttgcgaagcaacccgccgcagaaggtacaggtttggaagcggatgagtcgtggagagagagaacgttccacgagctgttcgaggagcaggcggagcgcactccgggagcgctggcggttgtctacgaagacagcaagctgacgtatgcggagctgaacgccaaagcgaatcgtctggcgtatgcactgcgggcgcgcggtgtgaagccggagcaggtggtcggcattctggccggccgttcagcagagctgttggttggtgtgcttgccgtatggaaagcgggcggcgcttatgtgccgctcgacccggattatccggcggaacggatcgaatatatgctcgcggacagcggggcgtcggtgctgctcacgcagacctgcctgctggagcaggcggaagcttggcgcagcgacggagctctagtgctgcaaacggtgcttgcgcttgacgacgccgcgacgtacagcctcggagcggcggaagcggctgtgggcgtacaagctttgggtgaagcaggcgcagaggcggaggctttggcgcaagcggaaacggctgctgccgaaaaatccgccacggcagaagccgagaagaacgtactagcggcggatctcgcatcgaatccggcgaatgtgaacaagccgagcgatttggcttacgtcatctacacctccggtacgacgggccgtccgaagggcgtggcggtggaacaccgcagcttggtgaacacggcggcgggctaccggcgggactaccgcctggatcagttcccgatccggctgctgcagctcgccagcttctcgtttgatgtgttcgtcggtgatattgcgcggacgctgtacaacggcggcactatggtcatcgtgccgaaggacgaccggattgatccaacccgcctctacggctggattcgcgactacgccgtgacggtgttcgaatcgactccggcgctgatcgtgccgttcatggagcatgtgcatgccgagggtctggatctcagctcgatgcagctgctgatcacaagctcggatgcgtgcagcgtagcggattaccgcaccttgcaggagcgcttcggctcgcagttccgtattattaacagctacggcgtaacggaagcggcgattgactccagcttctatgacgagccgctggagaagctgccgaagacgggcagcgtgccgatcgggaaagcgtggctgaacgccaagttctacatcgtggatgcgaatctgaagccggtgccgatcggggtgttgggcgagctggttatcggcggagcgggtgtggcccgcggttacttgaaccgcccggatttgacggcggagaaattcgtagacagcccgttcgccgctggggagcggctgtaccggacgggcgacctggctcgctggatgccggacggcaacgtggacttcatcggccggatcgacaaccaggtgaaaattcgcggctatcggatcgagcttggtgaaattgaagcggccatgaaaaattttgccggcgtgcgtcaagcgcttgtcatcgaccggacggacgagcgggggcagaaatatttgtgcgggtatgtcgtagcggattccagcttcgatctggaagggcttgtggcccatctcgacgccgcgctgccttcccatatggtgccttcgcgcatcatgcgcctggatcaaatgccgcttacgccgaacgggaagatcgaccgtaaagcgctgcctgtaccggaaggaagcattcgtgccgaggctgcatacacggcgcctcgtactcctgccgagcaagcacttgcgtcggtctggcagtcggtgctgggcgtggaccaggtcggcacgatggacaatttctttgcgctcggcggcgattcgatcaaggccttgcaggtatcgtcccgtcttttgcaaacggggtacaagctggtcatgaaagatttgttccattacccgacgatttccgcccttagtttgcagctgcaaacggcggagagaacggcaagccaggccgaagtgacgggagaggtcatcttgaccccgattcagcgctggttctttgaacaaaatccggccgacgtgcatcacagcaaccaggcgttcatgcagttctccaaggaaggctttgacgaagaagctttacgccaagcggtgcgtcagattgtcgtgcatcacgatgctctccgtacggtttaccgccaagccgacaacggctataccgcctggaaccgcggcgccggggagaacgaagcgctgttcgatctggaagttgtcgatttcaagggagtcggcgacgtgaaagaagcggtagaggctaaggcgaatgacattcaagcgagcatcgatctggaaaacggtccgctggtgaagctcggcttgttccgctgcgacgacggcgaccacctactcatcgcgatccatcacttggtcgtagacggcgtatcctggcggattctgcttgaggattttgctgccggctatgagcaggcgctgcaagggcagccgatccgtctgccgctcaaaacggattcattccaaacgtgggcgaaacagctcgctgattatgcgaacagcccggcgatggaaagcgagagagagtattggcagcatatcgagcaattgacctatgagccgcttccgaaagattttgaacaaggcagatccaagctgaaggacagcgggctcgtgaccgttcgctggacggcggaggaaaccgaacagctgctgaagcaggcacaccgtgcttaccatacggaaatgaacgatttgctgcttgccgcgcttggcctcgctttacaagcttggagcggccgggaacgcgtgctggtgaatctcgaaggccacggccgggaagatattttgccggatgtggacattacgcgcacggtaggctggtttacaagccaattccctgtcgttctggagccgggtcacgcccaggcgctcggtcatcaggtgaaacaggttaaagaaagcttgcgccgcattccgaacaaaggaatcggctacggcatcctgcgttatttgtcggcgccgcgtgaaggcgagtacttcgttttagagccggagatcagctttaactacctgggtcagttcgaccatgattacgaaagcagcagctcgcagccgtccccgttcagcccgggctccgactcaagcccgaatgctgtgatggattatgtccttgatatcaacggtatggtgtcggaaggagcgttggaactcacgatccgttatggggaaacccagtataaacgggaaacggtggagcgtctgggcaccctgcttcaatcgagcttgcgtgaagtcatcagccattgcttatcaaaagagcggccggagcttacgcctagcgacgtactgcttcaagatgtgacggtggaggaactggagcggctgtccgaacatacggtggcgctcggcgaactggagaatgtatacaccctgactccactgcaaaaagggatgttgttccacagcttgctggatgccgattcggaagcttacttcgaacaggtgaccttcgatctgtacggaagcctgaatgtggaagccttcacccgaggattggatacgctggtgcagcggaatgaggcgctgcggaccaactttattaccggctggagagacgagccgattcaagtggtattccgcgagcggaagtgtgaagtgtacttcgaagatattcgttcggtaagcgatgaacacccggagaagacgatagccgattttgtcagcgcggataaagcgaacaagttcgatctggcccgaggtcctcttatgcgtgtgaccgttgtgcgcacaggcgacgagtcctaccatgtgatctggagtcatcatcacattttgatggacggctggtgtatgtccttcatgatcaaggaagtgttcgacacctacttcgcgttccaggagaagcggacgctggagcttcctccggttacctcgtactcccggtatatcgaatggctggaagctcaagatgccgcgaaagcttcgcgttactggtccgagtatttggcgggttacgatcagcagaccaagctgccccaggagaaaacgcagctgaagcagggcgcttttgaagcggctgaaatcgatgtggaactcagcaaggaactgaccgggcaaatcgagcgggtggcgcgccagcagcaggtgacactcaatacgtttatgcagactgtatggggactggttctacagatatacaacaacagcgaggatgtcgtattcggctccgttgtatccgggcgtccggcggaaattccgggcatcgaaagcatgattggcctgtttattaatacgatcccggtccgtattcaaggtaaagccgaggagagggtagccgatatcttgagaaaaacccaggatcaagcgctggcatcgggagcatatgaaacgttcccactgttcgaaattcagtccctgagcgagcaaaagcgcgacctgatcaaccatattatggtctttgaaaattatccgatggaagaacagatcgagcaggtcgtcggtggaggccgagaagcgctgaaaatcgctaatatccagtcgccggagcaaacgaactacgacctggacattaccgtcattccggaagagcatattttgctgcggtttacgtacaatgcgctaacgttcagagaggatgacattaggcagatccacagtcattttgcctgggcactggagaaggttgcggctaacccgaacatcctcgtgaatcagttggagcttttgacggcggcggaaaaagagcaaattctcggcgcgtttaacccggcgcagccggaagcggctcctgcggccgcgttccaccggctgttcgaggaacaggtggagcgcacgccggaagaggcggccgtcgtgtacgagaatgaccggctgacgtatgcggagctgaacgagcgggcgaaccgcttggcggctacgctgcgcgcaagcggcatcggccgggagacgatcgtcggcattctcgccgagcgttcggtggacttgctggtggccgtgctggccgtctggaaagcgggcggggcgtatgtgccgctcgacccggattatccggcagaccgcgtgcggttcatgcttgaagacagcggagcgaaggtgctgctgacgcaaacggcgctgcgagagcgtgccgaagcctggctcggcgaagaggagctggcgctggcggcggtgctgtacctggacgacgaagcgtcgtacaacgaggagcgggcgaatgcgccggttggctccggcatggtctccggcaagctgacggatgctgtggacgacggcgatgagagccatcagaatgttggcaccgacggcttccatgaagcccgtccggaggacctggcgtacgtgatctatacgtcgggaacgacgggcaagccgaagggcgtgatgatcgagcaccgcagcctggtgaacacggcggcgggctaccggcgggaataccggttggatcagttcccggtgcggctgctgcagctcgcaagcttctcgttcgacgtgttcgtgggagatatcgcgcggacgctgtacaacggaggtacgatggtgattgtgccgaaggacgatcggattgatccgtctcgtctgcaccactggatggagcgggagcgggtcaccatcttcgaatcgacgccggcgctgatcgtgccgttcctggagtacgtgcacgatcagcagctggatatgagctggatggagctgttgatcacgagctcggacagctgcagcgtggcggattaccggaccttgcaggaacgcttcggctcgttgttccgaatcatcaacgcctacggcgtgacggaagcggcgatcgactccagcttctacgacgaggagctggcgaagctgccgcagacaggccatgtgccgatcggcaaagcgtggctgaatgcgaaattctacatcgtggacgcgcatctgaacccggtgccagtcggggtgctgggcgagctggtcatcggcggagtcggagtggcgcgcgggtacttgaaccgtccggaactgacgggagagaagttcgtagacagcccgttcgccgcgggcgagcggctgtaccgcacgggagacttggcgcggtggatggaggacgggaacgtggacttcatcggccggatcgacaaccaggcgaaaatccgggggtaccggattgagacgggcgaagtcgaagcaaagctgctgagtgtaggtggcgtgaaggaagcggtcgtcgtcgtcagggaagatcaagaaggtcagaaagctttgtgcgcttattatacagcggaagaaggcttgacggcggcggatctgaagcgggcgattgccagcgagctgccggggtacatgatcccgtcgtacttcgtggagctggagcgcctgcctctgacgccgaacggaaagatcgaccggaaggcgctgccggcaccggaagggggagcaggcggaggccgcgaatacgtggcgccgcgcaccgaacttgaggcgaagctggccgccatttggcaggatgtgcttgttcgggagaaggcggtaggcgtaacggacaacttcttcgacctcggcggacactccctgcgggcaacgacgcttgtcagcaaaatgcataaggagctaggcgttgaattcccgcttcgcgacgtattccgctacccgacggttgaggaaatggccgcggctatggagcggctggagatcggctcgttcatggctattccggctgcggaacctagcgagtattatccgctctcttccgctcagaaacgtctctatatcttgaaccagctggaaggagccgagctgagctacaacataccgggagctatgctgctcgaaggggagctcgaccggcagcggtttgaagaagcgttccgcgggctcgtagctcgccatgaaacgctgcgtaccggctttgagatggtaaaaggcgaagcggttcagcggatttacgaagaagccgccttccaggtggaatatgtgcagatcagcgcggagcaggcggaagaaacggtgcgccaattcgttcgtccgtttgatctagcgaagccgccacttctgcgggtaggccttgccgaactggcgccggaccggcacattctaatgttcgatacgcatcatatcgtatctgacggcgtttcgattgatgtactgatcgaagagttggtccgcttgtacagcggggagcagttggagccgctccgcattcagtacaaagattatgcggtatggcagcaatcggacgagcagaaagctcagcttgccaagcaggaagcctactggctcgacatgttccgcggagagctgccggttttggaattgccgacggactatccgcgcccggctatgcagagctacgagggccgcacgctgcaattgtttatgcatagcgagaaaagcgagggtctgaaacggcttgcagccgagaacggcgcaacgctttacatggttctgcttgctggttatacaatattattgcataaatatacaggacaagaagacgtggtggtcggtacgccgattgcgggaagaaatcacagcgatgttcagccgctgatcgggatgttcgtcaataccctggccatccgcagttatccggctgccgataagacgttccttgagtacttgaaggaaatcaaggagacgacgctgggcgcttttgaacatcagaattatccgtttgaggaactggtggataaggtgaacgtggctcgtgatttacgccgcaatccgctgttcgatacgatgtttgctttgcagaatacagagaatttggaaatccagcttcccggactccatttgtcgacgtatgccagcgaagaaattgtttctaaattcgatctcagcttggacgtcacggagatcgaggaaggcttggaatatctgtttgaatacgccactgctctttataaaaccgaaacggtggagaaattggccgctcactacttgcagctgcttgaatccattctccgcaacccatcggcgactattgccgagctgggcattttgacaccggcggaaaaagagcaaattctcggcgcgtttaacccggcgcagccggaagcggctcctgcgaccgcgttccaccggctgtttgaggaacaggtggagcgcacgccggaagaggcggccgtcgtgtacgagaatgaccggctgacgtatgcggagctgaacaagcgggcgaaccgcttggcggctacgctgcgcgcaggcggcatcggccgggagacgatcgtcggcattcttgccgagcgttcggtggacttgctggtggccgtgctggctatctggaaagcgggcggggcgtatgtgccgctcgacccggattatccggcagaccgcgtgcggttcatgcttgaagacagcggagcgaaggtgctgctgacgcaaacgccgctgcgagagcgtgccgaagcctggctcggcgaagaggagctggcgctggcggcggtgctgtacctcgatgacgaaacgtcgtacagcgaggagcgggcgaatgcgccgattggctccggcatggtctccggcaagctgacggatgctgtgaacgacggcgatgagagccatcagaatgttggcaccgacagcttccatgaagcccgtccggagaacctggcgtacgtgatctatacgtcgggaacgacgggcaagccgaagggcgtgatgatcgagcaccgcagcctggtgaacacggcggtgggctaccggcgggaataccggttggatcagttcccggtgcggttgctgcagctcgcaagcttctcgttcgacgtgttcgtgggagatatcgcgcggacgctgtacaacggaggtacgatggtgattgtgccgaaggacgatcggattgatccgtctcgtctgcaccactggatggagcgggagcgggtcaccatcttcgaatcgacgccggcgctgatcgtgccgttcctggagtacgtgcacgatcagcagctggatatgagctggatggagctgttgatcacgagctcggacagctgcagcgtggcggattaccggaccttgcaggaacgcttcggctcgttgttccgaatcatcaacgcctacggcgtgacggaagcggcgatcgactccagcttctacgacgaggagctggcgaagctgccgcagacaggccatgtgccgatcggcaaagcgtggctgaatgcgaaattctacatcgtggacgcgcatctgaacccggtgccagtcggggtgatgggcgagctggtcatcggcggagtcggggtagcgcgcgggtacttgaaccgtccggaactgacggaagagaagttcgtagacagtccgttcgccgcgggcgagcggctgtaccgcacgggagacttggcgcggtggatggaggacgggaacgtggacttcatcggccggatcgacaaccaggcgaaaatccggggctaccggatcgagacgggcgagatcgagtcgcagctgctgcgggtggaaggcgtgcgcgaagcggtggtgctggttcgaagtgactcgaacgggcagaaagcgctgagcgcgtactacacaattgatggcgaactgacggcggcagacctgaaacgggcgatctccagcgagctgccgggttacatgatcccgtcgtacttcgtggagctggagcgcctgcctctgacgccgaacgggaaaatcgaccggaaggagctgccggcgccggaagggggagcaagcgcaggccgcgaatacgtggcgccgcgcaccgaactggaggcgaaactggtcgccatctggcaggacgtgctcgggccgatcacgattggcgtgacggacaacttcttcgacctcggcgggcactccctgcgggcgacgacgctggtcagcaaggtgcacaaggagctgagcgtggacctgccgctgcgcgatgtgttccggcactcgaccatcgaagcgatggccgaagcgatcagccaattggagcggcaggaacacctctccattccggttctggataagagggattactatccgctttcctccgtgcagaaacggctgtatatccagcagcagatggaaggcgccgagcttagctacaatatgtccggcatgacggttctcgtcgggcgtttggaacggaatcaattcgaggcggcgctcaaaggattgatagctcgtcacgaaattttgcgaaccggcttcgaaatggtcgacggcgaaccggtacaacggatttatccggacttgaagtttgccgtcgagtatacgaaagcgatggaaagtgaaacgaagagcatcgtagacggctttgtacgcgtctttgatttggagcggccgccgctgctgcgtgtgggcttagtcgaaatggaagcggaacggcatctgctcatgctggacattcatcatatcgtcacggatggcatgtcgatgggcatcttcgtcgaagagctactgcgcctgtataacggcgagactctggaaccgcttcggattcaatacaaggaattcgccgcttggcagcagtccgaacctgtaaaagagcggctgaaacgtcaggaagcctactggctggacgtgctggaaggcgaattgccgacgcttgaactgcctacggactttgtcagacctgccgctcgcagctttgagggagatgtgctgcctttcagcatcgacaagcagatgaccgacagcttgcagcgcatcgccgatgagaacggtgccaccctttatatggtgttattggcggcctattcaatcctgctcagcaagtactcgggacaagaagacttcattgtaggcacgccggtttcgggccgcacacatgccgacctggagccgctcataggaatgtttgtcaacactttggcgattcgccattatccgtccggggagaagacgttcctcgcttacttgaacgaagtcaaagaaacaatgctgggggcctacgagcaccaggattatccgttcgaggagcttgtgaaaaagctgcaggcaccgcgagatcaaagccgcaatcctgtattcgatgtcatgtttgctctggaaaccaaggaagataacgttcaaagcttcggggatatcaagatcgaatcttatccggaaactcatacggtttcccaatttgatcttaccttggtcatttcgttgctggatgagggaatgaacgggcagtttgaatatgccaccaagttgtttacgcgcaatctgatcgacaatttcgctcaggacctgctcgtgatcatcacccaaatttgcgaacagccttcggcgctgttgaaggatatttccctgaacgggcaatccgaacaggagcaagatgtgctagaggccattgatattattttctaatcccttacccggcttgggtgtatgccgtatttctctcggtacgcatcctgccgggtgtttttttccaaatgaaagggaaaaatccaccacaggaatctgacgtcaagtgccgctgagtaacgattttaatgtattggaaaatcgacaaaacacaacagagttcttagtttacctttggtatactaagaatcaaaccattaaacagggataattccagatggatgaccttatcgaagatgccggaatcacctatgtgttgaccgcggttacgtggactacaaagcattcgatcgttattgctcggacggaatatacttcgtgactcgcttgaaggagaacgcggtgatcgaactgctccaatcgcttgaaatttagaggacagcaaggtcaccatggatgaatgggggctggtaggttctacgcaaaagcggatgaagcacaagcttcgcatgatggaaacaaccgattcacagggcaaacgttatagatataaataggaatatacttagtcgctgcaaatggatttaattataaggggggagtatctttgatgtgtaactgaattacgaattgacaatcatacaggcgaagcagatgatgattatcgatcatcagtcgtatggatttaaaatcttcgagggtcttgtttgtaatcaatttatagaaatatcatattattaaccaggggaatatggaaaataaaattgtagactatgaaaatgaagatgtaaaatcaaaataatccgccactgtataaatattctttaaggactgtattggtagttcaacaagtgaaagcacagtataccaaacaactggaacagagaacgcaatgtactcggcgtaccttagaaacttaacgaaaatttatgagtaattgtgtaagaaatgggggattggaatatgaggtttaggaagcggagcttctccgcattccatagaagtctttagaaaaaactttaattgacacggttagctacttgagctaatttcaaaaggcaatttcaattggaatgtaaatacgttattactatgattaagcgttaaggtaccttgatgtaactcaacaatatttctagcaatggaaaggcccagtcctgctcctgtttgaataccttcgctccttcttgaatggtcaactttataaaaacgatcaaatagcttctcctcttggtcttgcgtgagaggagctcctttattttcgacctcaatcgtaatttgctcagggctcgttttcagtcgaatgcaaatgcttcccggcttcaaggaatactttaaggcgttcatgagaagattatcgattgctctagccattttatcgctgtcaatggaggtaacgatcggggagtcaccgatatctttcacgatatatacaccgttttcttcagcaatgggttcgaactcgaatagcaattgatccaagagttgaaataaattgatgcttctgagatttaagtgggtatcgacagaagtgagccgagtatattcgaacaagtcatcgagcaacttcttcaaatgaattgctttgttataggtgttttgaacaaagcgcgtatattcatctttatcctgatatgagtctgttcttaaaagctcgagatagccgataatgcttgtcagaggcgtgcgcaagtcatgtgaaatacctgtgatcaactccatcttggatctctctatttcacgttcttttacaatctgttgctctaaacgttctgtcattcgattgatgttgagcgcaacccgtccaagttcatcttgccgaacaacaggtactcgataatttaaattaccttcggaaataatctgaagcccttgctccaatgtaattaagtctttaacgattcgtcgtgtcaaaactaaaaaagtaaaaataaacgttaccataaacaaggaggtaagaagataaggaaaaaaattgcgaaaccaatgccatcccatagcactgctaattttcaagaaaagtaaaatgagaatatcatttatagcagtggcgataataaagcttagcaccattctgaataaaatgttgacttgaatccgtttttttcgttttggcttttgtacatgttcattcaattttatagccaactccccacaccgttttaatatacagaggatctcttgggaactgctctaatttttctcgtaaattacgaatatgaaccattacggtattatcagaaaatccatatggcgccttccatacattttcgtaaatgtgctccgaactaaaaacctgtccaggatggctggcaagcaagaccagaatagcaaactccagaggagtcaacgaaatttcgttgccctttaactttacggaatgtttactcttatcgatgctcaggtctttaataataataagggaattaaattcttcttttcctattaatgcctgacgacgtagctgcgcctttacgcgagcaagcaattctaatggattgaacggtttgatcatgtagtcatcggccccagtggtcagtccgttaattttatcaatatcttcttccttggctgacagcatgataatcggagtgttcgatatttcccttattttaaggcatgctctgattccatccattcgtggcatcatgacatccaggataaccagttgaatcgatgttgtctttatggcatccagggcttcttcaccatcggctgcttcaattacatggtatccttcattacgaagatatacatgaatgacatcccgaatctcggaatcatcatccacaacaagaatggtattcattactgactgctccttcttttttgacttggtagaattagggtatctaaggtccctcaaattactgcaactagtatagatatcttgataataaggtaaagtcttcactttttctacatatgcataagcaaaacatttaattgagtaaattgaagtgtcatcatcatttaaattgtttcctttttgcgacagacgtaaacgaaagcgggagggatattgaaaggcactaaatcaattttttcaatgataaatttttcagaaagcggctttttcatttgaagcgaatattgaaaggcgataaacaagcctccaggtttgagtgctttatagatctgttcaaccaaggtatctctcaattcacgatcaaaattaaaaaaaggtagtccgctaaaaatacaatctaactgatgaatgttctcttgcttcattgcttctactaactgagcagcgttcggatgacaggagaagtctgggtattctgtctgtaaattattcctcatattctcattcatctcaaacaataatactttcgtgggttcgctcacctgggcgctgataaaacgggtgatagcacctgtgcccgatccgagttctgcgactgccttaatctcgttccagggggcttgtttcaccattttggtcgctagaaatcgggagcttggtataacactgcctacattttttgggctgcgaataaagctttgcaaaaataaaaggtatttattaagtttcaattgattttcctccattactgtttttattgtcaggaacaatgctgaataagccgaaacgattaaaaatgagaaaattgaagtaaagacataaggaggaaatatcgtacgattgggaagaacacaccgatgcacatggcccaatctcctctatttttgcacctctttattatttcgatacagaaatcataatgaaaaaaactaaggaattaatgagtatatttctaaagaaaatctaaagattcatctatagaaggtttaaaatctatatcatccaacccaaaaagccttaccgaccaagtcggtaaggcttttttataagggcaaactgtttcgccacgcaattcaatgatatttatggctatagaaaggccaagcgctactctaatttgtatcccttcataatgttggggaggaggatgtttgtgatcgtttatgatcgtgtattttcttctacttgtatgtagggtgaagctttgctttcactagtacgagtgggaataggagagagaattctctctttttcaatttccattagtgctaaataagtagaattaccaaagtgttaggataaagttgaggtctgattagcttggttaaaagctgatcagacctttcctagattgggcgtaaaacagtttaagatgtcaagccagggcttggaggggagaattaaaggcgtttttgtattacttcagaatttctttagaaatatccctataagctcctaagatttttataataatatactttcatcgacattaacgaggaggttagaacatgattagtgatatcgtcttacagctagtcgatcattatggatatctcttttttttcttagccttctgcctaggcccattcggcgtcccggttccaaatgaaataaccatactaataggtggaattttgagtaacaacggagctttaaacccgtggattgtatatattgttattctcgcaggcttatttacagtaattacaattgcttattttgcgggcagaatctttggagaaaaatttaaactaaagtttcaaaacaaccgtcactttcagaaagcagagaaattttttgaacaacacggagatatcgcaatgtgtcttggatatttcataccaatcattcggtatattttgcctgtattcgttggtctaaacggtacctcatacaagaagtttgctttgatttcgtattccagtgcgtttgtttggaccgctacgttctttacctttggcaagttccttggacattatatattgaatttgctagatttgatcgatcctaaattggccgtggttgctctaatgatagccgttggcacctttatcacaaccaagtggttcaagtcgaaattatccgaccttactgcataagctggtgaacaaatgaaaaaaatagaagaaagggggagagtcatttgacttcaaatcagtatgtaatgttcttgcaacgatttattaaaaatccaaagcgagttggaagtgttttgcccagtttacggtctctggcgagtaaaatggttcaatctgtgtcatgggaagatgtgagcacaattgcagaattcggttctggcacaggagctatcacacgctttatcgaactgtttaattttaagagcgaattaagagaaactttactccatcaaattaccgaatccttaaaaccagagggcaaatttatcgcttttcaatactcccttcagatgaagaaacatttatctgagaaattcattattgataaaatcgattttgtgcccctcaattttcctcctgcttttgtttatacatgccgtaagaaggaggggatttaagtgagttatgacacactaattcattggattgcgcagtttggttatgctgctttattctttgcattatggctcggaattgttggaatgccaataccggacgaggttgtcgttatgaccggcggagccgttagcaaagtaggattactccattatttcccagcatttattatcacttatttaggagttatctccgggctatctcttggttatattctaggcaggtttttcggttcgccggtgctggataaacttcgccataaaaaaaattggggaagcatatacaaacatcagaacaccttttaaataaatatggaaatattgcattgagttttagctacttttttccggtggtgaggcatattgttccctatttagtcggaattaataaaatgtcatttcgccgttatattctttattcctatacagccgggcttgtttggacgtctgtcttttttgtagttggccaatttgcaggtggtcatgtggaaacaatcgggacaatgatttatcactacggtatatatgtgggacttgccttaatcataggaattgtcatattcatgattcttaaaagtcggaaaaggagcaaagcgtgatgtgtggaatcaacctttaggagatttagataatacggtagtagttcaaattctgaatttacacgagaaaatagatgatctctcaagagagccgcgatatataaaaaccgtttggggagttgggtagaaaattgaaactgataaacggcaaaagaaatgtttgctttgagatttttctggcgttagttttcagtctcgtcattgcatatctcagtttcgccattgtaataacttgtatcaatttgtttgtaaatcgatttcaagcgggatatttttttctaaagctagaccagcctttatttttttttttaaaactgacccgacacatgtttaaatacatttttgatttggccgaaagttcgcaagttcacttttgatagatttaaaggaaatacaacaaagttatgatttcactgttgctatatattctagcagctcaaacggttttcacataaggcgaactgttgatttataaatattaatcgtcatagtcagatatacccccaccaactcctgaattttattcatcatcaataataagaatcgtttcttgggcatatgaaagcatcctttctgtgccttcagtttatgccgatttcttgtaacataaaagtaaagtaattcttaacagtttctgagatttgattttttgaaaaggagagctgtgttccatgaaaaaaggaacgaaagaaaaaatgttgattcttaccggaaattatggaaatgctcacattcaagtagcccaagcaatacaagatgcgatgaaaatccgatttcctcatatggaacctatcattattgattttatggaatgggtccatcctaaagagtccgcgtttgcttcaggagcaggatcatgaatcagacattgataattctcattagtgcattactcgtctacacgattatcccgacccttataatccgactatttggaatcggagtttataaaaggggaacgggcgagcagcccattgccttaacttttgatgacggtccagacccagaatttacgcctcttttgcttgatttattaaagaaatataatataaagggtaccttttttgtccttggtcgcaaagcagagaaatatcccgatttaatccaacggatgcacaatgaaggacatcttgttggaatccacaattatgtacattggtcaaatgctttaatgagtcctaagagggttcgcgaacaggtaaacaaaacggccaatgtcattaatcgtattattggagagaaagccttctattatcggcccccgtggggagtcattaacctatttgatttttttcttatgaaacaatttcgcatgattctttggtctgttattgtaggtgactggaagagctctggcggcaagcaaaaagttaagcaaaggctgctgtccaagctaaagggtggagctgttatcgttcttcatgatagcgggcaaacgtttggagcagacagggatgcacctgcatacatgttggaggcattaaatgaatttatcattgaagcattatatacaggatattgttttcagagagtagatgagaaaagagctgcataatgaacaggctaaatatatgagcattaattatggtacggccgtgataagcgcggcttttttgttttacataaacacattatctgtcagcactctcgaagattatacgtaaggaaacagagtaagtttaattttgatactaagaatcaaaacttaagcccgggacaaagtattgttcgggacttaagttttttaacttatacatcaaggttgccggagtggcctacttctgatccaatggaacgggtcagaactctttcgaaaggcaaagtaagagtaaatttaaatatgttatttatatgattgagcgttaaggttcctccatgcaactcaataatgtttctagcaatagaaagacccagacctactcccgtttgaatgccttcactacttcttgaatggtctactttataaaaacgattgaagagtttattttcttgttcttgtgtgaggggattccctttattttcgatctcaatactaatttgcttattatccaacttcattaaaatacgaacggttcccggctttacagagtacttaagggcattcatgagtagattatcgattgctctggcaatttttttactgtcaataacggttataataggagatttgcctaaatctttaataatattgataccgttctcttcagcgatcggttcaaattcaaaaactaattgatctagaagctggaatacatcgatcttatttaggtccaggcgggtatcgaccgaagtaagtcgggtatattcaaacaaatcattgagcaatttttttaaatgaatagctttgttataagtgttctgaacaaatcgcgtatattcatctttattctgaaatgaatttgttcttaaaagttctatatagccaataatacttgtaagtggcgtacgcaagtcgtgtgatatgcctgttatcatctccaacttggagttttctagtttacgttccttttcgatctgctgttgcagacgttccgccatcaagttgatattaaacgcaaccctcccgagttcatcttttcgcatgacaggtactcgatagtttaaataaccctcggatataatttgaagcccctgctccaacgaaattaagtctcttacgattcgtcgagtcaaagccaggaaagtaataataaagaaaagcataaacaagggggggggaatatacggaatgaaattgaggagccactcggatttcatgccatagccaatctccggtaaaagtaaaatgaacatgttatttatggttgtggcgataataagacttatcatcattctgattaaaatattgacctgaatcatccttttttttcgttttggcttatgcacattttcagtcaattttataaccaaccccccaaaccgttttaatatactgaggatctctgggggatttctctaatttctctcgtaaattacgaatatgaaccatcacggtattatcggaatacccaataggatcttcccacacactttcgtaaatcttatcaaagctaaatacctgcccagggtggcttgcaagcaactctagaattgaaaactcaagaggggtcagtgaaatgttattttctttcaatgtaacggaatgtttagttttatcgataacaagatctttgaagaatataagagaattaaattcttcttttcctattaatgattgtcgctgcaaatgagcttttactcgagcgagtaattctaacggattaaagggttttatcatgtaatcgtccgcaccgggagtaagacccacaattttatcaatatcttcttccttggccgatagcaggataatgggggtgttcgatatttcccttattttaatgcaagcattaatgccatccatctgtggcagcatactatctaagatgacaagttcgaaagagattgatcttattaaatctaacgcttccataccatttgcagcttctatgacaaagtatccttcattgcgcaaataaacgtgaatgacatctcgaatctctgtatcgtcacctacaacaagtattgtatccattacatgatacccctttcctattttttatgattacggctactaaaattctataattaaggcaaatccaataattgctacgaaaagtttattaataccgattattgcgtccacttttgcgacaggtatatacaaaaactggagggaaattgaagggcacgaactcgattttttcgatgattaagtcttcggcaaatttttttttcatttgaagtgagtactgataagctacaaaaattccttctggttttaatgccttaataatctgattaagtaaggcttctcgcatttcactcgtaaaattaaaaaatggcaatccgctaatgatacagtcaagctggccgatgtcatcttgattcaattttttgattaattggcaagcgtttgaatgacacgcgaaatccgggtattctgtcttcagagtagctctcattttcttatccctttcgaacaatagcactcttgttgatccggttaaatgtggcttcatgaaacgtgtaatagcacctgtacctgacccgagttctgcgactgcctttacctcattccatggtacagactcaacgattttagctgctagaaatcgggagctaggtataacacttcctactcgttgtggatttgtgagaaatccttgcaaaaaaagtagacattcactgatattcaactgtttttcccccattatttaatttctcccaaatacctgccgacagtaaaaaacgtcactgtccataataaagcgctgcaatatgatatcagggcaaatttactgaattcaaccctgcttaacccaacaaataaagggatgatatatcgaacaactggaagaaataatccgaaacatattgccatatctcctcgttttgtttcatataaaaatagtaacgaaaaaatctaaggattttacgaggatatatctaaagaaaatctgaagatatgtacactattcagactcgaagtctgcaagaagtgcacgaaaattagaaagctgatctgattgaagaacccaaaaagccttgccaacaaaaataagttggcaaggctttttattacgtaaatcgttgatgaatttccctataaataagatgcgaaagggaataccccttaccaactaatgttaagaaattctttagaaaaatcctctaaagttcttcagagtttatcattatgatgggttcattgctatagataaacctaatcaggagaacggatctagatcgcctaacgccattcgctccgtcctttattattccttatgttctttggtaccgttcattgcatctgtactgatcggacttgcgttcaaggacagaacagcttattaccggacgctacttgcgatctgtggagggctgatcctttcttatatcgtttatgcccttttccaaacggctgttcaccgtccagacaatctagcccagacaggcgtcatcaaccgtttggtctggttggtgtacagccatgaccagccgtttaactgtttcccgagccttcatgtgctaaccagctacttgatgcttcgtggagcaagggtattcggaagaacgattcgttgggcagtcaccgcaatgtctattgtcattatagcgtccactttgctggtcaagcagcatgtactagcggatgtcgttggcggtatcctagccggagagctgttgtaccgatcggcaggcatagccatatcatacctacggcgacacagaaatcgcctgcctctgaaaggaggcgagcgtcatgtttctgctgagtaaagagagacgctcattcatatctcattttatgagaaaaccccgacatatgattacattgctaaatcgttcatcccgaaatacttttagccaaagcagaaagcagtctgcacgtgtctatgattcatttgtagttgctcaaaagagaacaagataattcatataaaaatgtgtttgtacaattatttaaaaatagaagagggggttctatgaaaaaacgtatgttcattttattgctgttggccttatcaaccagttctctttcagggtcctttgttcaagcagaggggcagcaattggcttccaatgcaagtgtgcaactaacattgagtcaagcccagcaatgggcacgatccaataactttagcttgaaggaggcccagcaaacgatagatcgcaatcggattaacttgaaaaatgcaggtaagaatctggacttcattcccgcaggtacagtacaggtaatggagaagaggatgcggacagtagttcagcatggaaggggtatgcctcatcgacggtttcttatctggaatccaaaaagcaaatcgagcttgcccaagatcagacagactacactacaatgaagaactattataaagaagttctgcttattctgggcgacgagataccagtcggacaagatccagcgtaagcattggaagtgccatacctgccgggtaagctaaatatcttgcttgccattcaggagaaaatttttctttgtaacggcgtaatccctcaaatccataccagtgcccaccatattggaataccagacgagctaatttttcttcacgatgtgcattaagattttcacccacactggagagcggagacatgcccaaattgaaataagaataaccttgttcttttgcccattcaattaaacgtacaaatagcacatccatcgtaccattcggtgtatcattcaaatggcgcatcagatcaattgagatcactttatgttggtcataagctggagataatgttgcaaaagccaaaatgtgaccttcagcattacgaagcaatgttaacggagagcgctgaatatacgcttcgttaaaccagcctaaagaataagctttttctttacgatcgcctagccactcatccgaaatctggcgtaattcagacagtaattctgaatgatagggtgggacaagcacttcaaatatttggccttcacgacttgatttatttttagcagttcgcaagttctgcttacttttcccacttaatgcgaatgtagttagaggaaccaaagcttcttcgcctagtttgaagaatttgtaaccattctcatgatagatcgatagatattcaggtgttgcttgataaaaaacaacggttaatgcatactgatccgcatacctctgaaattcttgaatcgcagcaccgacaagatttttattgccaactgggtcgccaagtacaattaatttgtggcgaactcgagaatagggaatcaaaatttgatcattttgcgcccagtaaaaatttttgtctcctagatagagaagatgagtcaaaagattaccgtcttctttggcaagaaattgagttaatttctctatacccgcttcatctggacgcgttcctatgtagcgatgcggacgtaatgtgaatatagaagccattaaaattaaagcaccgataaatccaacaagggccgtcactgcatattcatgcgggttcaaaaaccattgttgagcacgcattggtagatgtcgcagaatagctggatgaatatgtgtaccaataatgtaacacgacaacgatgaaatacaagcaagggacgcccaaatccagatactacgtgaagaaatactagcactttcgctattaaatcgagcacgagatatccacagtatcaatgcaacaataagcaaaataatagcttcctcgtaatcgaaccctttggcaaatgtgaaaatagcacttgctaacaacaatgctcctgtccatatgtaagctcgacgagtgcgcattgaaataccacgtgatacgacaataagcataataccgatagttacagatagctgttctgaaagacgcataataggtaaagataacacatgttccataaaacgtaggcgagcaattaggcctgggatagccgcagaaagtagtaatatgataccactggtgaatactaactttccaagcgcccatgctcctagatcgctaagtaagctgaaatgagaaggccagccccagaatttgacccatgtgttacgtgaagcgtccagactagttgtaatcatttcacgcatttgtttactgttcggactcatctcaaacgtagctagcacaagaccgatcaaccaaggaactacaaagtaaaaaatgcggaacaataacaaaatcgttagtgcacgtgatgaatcaacacctaatgtctgaagtccaagcaacacgatcagatcaaatgctccaataccacctggggccatactaataatccctgcaattgccgctacaacatacacaccaaataccggggcaaacggcaaatgattcagattataaaaagcgaataaccaaaatagggcccctgcacaagcccactctagaacagaagaacctagagaagcggtaaccagtttccaaggtaacgtgccatcgcacttatgaaaccatttggcgaacaggggagatcgttgtattaataagaagaacggtaagtacaatgaaactccccatacaccgatacgaagccaaggaagttgctcgaaaataggttctacaggaaaaacaccagccagtgcaagacaaccaagtaaagatagaccaactaataagataggcgataaaaaaagtacggcagtccccattgttttcataggaacgccacttttcttatacaataatgtacgtagtcctacaccggtaagaccagcgaacccaatcatattattaaatgtattggctatccaagcatatcgataagtcgttttccaattgatatcgagctgaaattgtttttgtattaaataatcataagtactcattacagataccgctataaaagaagcaatgatcaattgaataacgacatgaacgggcatcatgcgtaattcatgaatgattttagctaagttaatattctgaatctcgtgtcttccatatacatagataaagactagaatagccataggaatcagtatcctaataattttagtacggtacaaagccataagtagctgtaaaattttaagctttcgaagcaattctctcattgtgtcgtcgactccaccttcggacaaaataatatcaatatttttaatacaagacggataccgcgttgctaggacaaatagcgtcagcaaaataaactagcaggttatgtatagcttccatatccgcctagcaagcaaactacttggttatgttcaattattgtggctacgtacgcttcattttactgtggccagatacgagcttagttatatatgggattgtattctaaaagaactctgagagagggcaaaataaaaatagataggcatagtggttaattagatttattaagttattactgaccattttgaacttctctctttttctttcagaaggcataataaaaaaaactaaggaattaatgagtatatttctaaagaaaatctaaagaatttgaataactaagtaataacttgaaatggagattctttcactaagactctccaacgtgccatgctatttaaagttgaacaggacttcctacgaaagtgctccagttgcaagctccatgattaagcttctgcgcccccatctcggttgaaagacggaattcagtgtgaaagctctaactatgcaaagtaaaacccgatgagcaagttgcatcgggtttttattaaagttaggaatattattttataatatttgaaaataggtaagcgaaacacaattgtgcttgaatgaggacggaagagcaaaaaattggacggagctataatggaacttgcaaaatcagatatacgtgaagcgaggaggaaagaaattcaaatgaaccaattactcagtaaatatagcgtcgtttaccgaagcacaccaagacagatcaaaattcaagtatttactgctacggtgcgtaacgatgtacttcaacaattcctcaatctggatcgctctatgcagactttgaacagttaaaaaaccagcctgactatgagcaaagaatactttcatttgatacaaaataggtgctacccgatatgcataccatgaggaataaaagtggaatatcaattgtttctggattatacaggggatttcttaaatacctgattatattcaagctgcgcatcggtgatcgccagctttgaatagatttacagcgattttcttcatggccggaacatggctgaatcagtacattatcaaaaaaaacagccactaaagggctgcttttgtactatgggctaattgctcgtgtattttacccaatcatattcggcgtatagcggattcgctccattatacgaacctagccagtcgtcaacgccagtgccattccataaattcatcataatcttgcctggcgtgcttggtatgttcgtggttgccgtatgctttagaaccccgtcaacataccacttaatgtaccctggctgccaatcgaaagcataggtgtggaagcctcttgatgcatcaaagcccagatcaacaatcttctcgtgaccaccgaccccgtttgtataataattgaattgcacttttgtcgtgtctttgcctaaaaattcaatatctatttcatcccattgcgtgccatcagtaggtcccgtatacgtaaaaaaggaagatacgatccctgtatttttagcaggcttcatgctgacctcgtataagccgtatctgtaagtgttcgtcgatcgatactctccgcagtcaaacttattgtacgcagaacttgttaagccaagcttcattttgccatcgttcgtaaaattgacattattggcacgccaagtgcaattaaacatgttcccattggagtatccatccgccttttgccatgcaccagaattgaaaccattaagtggttcccaaaaaacattccctgcataaacgcttaccgaaaaaaacagagagacaatacccgtgaccattaaagtgaaccaagatttcttcttcattttacacctccatacaatattgaccaaacatggaagaaatggatgacaatgacacattatttcaagtattggctatcttaccggacaaatataaaacgcttccaaatttggcatctttattgtagcttgatattgagtcgtccacaatagcaaacttaacgcttgagacataatttgaaaaaaactaaattttatcaagttgtggtttaaaaatgtaagtactataattatatacaagaaatacaaataaacgttataatttcccattaaggggggatgattttgcaataggatagactcaggaagcggagccactacatgtttataccattttattcttttggtataatagtcaattaatttttaaaagaggaggcctttctttgaaaaaattaggtatggtatgtaaaatagttctgatacttgtattcatattgcctttaacaccggtctttggccaacatatagatgcatggtcaggtatgcctatgggaaagctccatgtcaggggcaatcagttggtgaacagcagcggaaaacctgttgttttaagtggttggcatcagccgtcgggggcatactggacctatcaaaacagtaattattatctcaatttgaatggtaacaatcgtcatgcagcaattttggcttatttgaaggatatcactgacacctttgcagacaccagaccgaagtatggaagcaatcacggttggtatatgaatcaggtccgattgtttattgaccgccaggatatgggagatgtggccgcagggtcatacaacttcgccggtttacaggcagttacacaaaatgtgattattccatacatcaattatgcgaaaacaaagggcgtttatgttacccttggtcttgatttcactttggctaacgaccaggctaccacacaatccaatttggacaaatttaatcaaatctgggggtatcttgcctcgcagccggctatcaagagcgcggataacgtcatgtttgaactgatcaacgagcccattaagtcgtatgcgaatgggcattggggaggctatcccggcgaaaatgattttgttgaccactggaatgatctgagaagattccagaactctatcatttccacgattcgaagtaaaggagcggataatgtcatctgggctgctgggcttggatacaaccaattttacagcccggcggcaaaacacccgctgacagaccccttgaacaactacggctatgctgtccactggtatccgggctacggagcttatgatgacaaggacaagctgcaatcgcaatgggattccaacattaaggcggcagataaagcctatccaataaatattacagaatttacttggttcaaaacgcagcccggcgattcagagtactggaatttgtttaacggctctagtgatggatttgggaaaaacacgaagtccatttttacagcagctggtaatgtcagcatgaccgcacatatgaatggctttctgctggaatctggagcaaggagttcatttgcggacccaacagcagggttaaagtgggatggcgatacccgacgtcaggcgatggcccgcttcttgtttggctggtactatgagcgtgcacaagcctatccgagagcactgctccagaacagtgaatcagcaacggataatgtgcctgcggatgcaccgactgatgtgcttacagatacatacattaatgcaccgactgacgcacaatcagaatgatgttaatactttaagctaccgacagcctatccaattggataggctatcgtattattttatagaaatgactagtgtaagattgacggccattatgaggccttccgttatgtaaagttgttgaaatgatgaggagagagtatagtttgtatgtatttattttgtgcgggaagaggttaatatgggcgacaattcatgatgtagcattaaaagcgggcgtgtcggtcacaacagtatcccgtgtaatgaacaaccggggatatatcagcgaaactacacgcaaaaaagttttcgacgcaatggaggaacttaattatcaaccgaatgaaatagcacgttccctattgcgcaagcagtctaatattattggcctgattattcccgatgtctcgcatcctttcttcagtgagcttgccaatcaggttgagttctatgcctatcagcaaaactgcaaggtcctgctgtgcaattcccatatggatcccatgaaggaaaaagtgtatatcgatatgttgaagcggaatcgggtggatggcatcattatgggtagccatacattagaaatagaagagtaccgacatttgaattcaccgatcgtgacatttgatagacagattgacccgtgtattccttacatatcctcggataattatcgcggaggcgagctggctacggagctgctcatcagcaaaggctgccagaaaattgcgcatatatgcggaaatctggagctgaacatgctgtccaatgagcggaccaaagcattccgggatgtcgtgggcagggatggtgtccagcatgtgatcgttcaaacagacttgaatgtgttcgaccagaaggagtacgagcgaatcatttcaaaactcgttcatgaacatcccgatgttgatggagtgttcgcaacaagtgatattattgctgcttttgcgctgaaagaatatattcgcgctggaaggcatgtgccagagaatgtgcgcattgtaggcttcgatgatgtaagcgttgcttcctggctgacgccggaacttacatcgataagacagccgattgcagacatcggcagactggcggtcgagctgatccgcaggcaggcggaaggggagcaggtacaaccagtcaatctgctgcctgttgaactaattgagcgtgcaacgacctgaatgaaaatctgttcctctaacaaggggtacagattttttttagtacatgttaaaaattcaacatgtcaaacgattgacacaagtttaaacctttgacatataatccgtttgtaagcgttttatttaagtgttcagagccattatataaataaggggatgacaacaatgaggaaattcaaaagaattcaatggacggtaatgctacttcttttggttatggtggtgtctgcatgcagtggctccggaggagaaggtaattcggcttctggagggggatcaggggattcgaaaaatgtgaaaattacgcttttgaactccaaaggcgaaatccttccacagctggaggaagccgcgaaggcgttccagaaagacaatccgggcattactgttgaaatccagccggttccgactggtggatctccttttgagcgtgcctctgcattgtatgcatcaggaaacccaccgaccatgaccatgctagatacaggggatgttgagaaattcaaggatcgtatcctcgatctaagcggggaaaagtggaatgcggacactgttaaaaatgctaccactgctacgacatttgatggtaaaaattacgcgtttccgctggctgttgaaggctacggattcatttacaacaaagcggttgttgataaagcggtaggtggaagctttgatcctaccacaattaaaacccgaaatgaccttgaaaagctgtttcagcaaatcgaggcatctggtaagaaagcattggtgatttcaccaatggactggtctctgggcgctcattatttgcctcttgcttatgcaggccaaaacaaagacatggctgaagtggacaaattcatggcgtcactaaaagcgggccaggctgacttggctaataatcctgtatttaacggacttatggatacattcgacgtcatgatgaaacacaatatcgatcaggcttctccgctagcaggagcttatgaacgcggaccggagctgctcggcaaaggtgaagttggcatttggtttatgggcaactgggcatggccgcaaatcaacagttttgataccgctaacaaagaatatggttttctgcctgtacccatcagtaacaatgccgatgactacggcaatcaggagatttcgtccgctgtatccaagcgcattgttattgacaaggagaagactactccggaacagcaagaagcggcgaagaagttcctgagctggatcgtatatgatgagaaaggccaggatttcctcgtgaataaagcgaacattatcccggcgttcaaaaatattacactgcctgcggccgacccgcttggcaagtccatccaggattatattgcaaaaggcaagtcagagcagtcgatgagcatgctgcctgccgaccactggtccaagacaggatcttctatgcaaaaatatctggcgaaacagggcgatcgcgcaacactggttaaagaaatcgaaaactactggaagaccgtaaaataaggttgttttcaaattacccggaatagagagagaaatcagggatatagagagggggagcatcatgattacagaaaaaggagtatggaatcggctgcggacgcggctactgtttaccggaccaaccttgtttgccttcataacggtaatgatcattccatttttgtacggcatctatctgacgttcacaaactgggatggtatttccaccacactatcgctggttggcgtccaaaactatctggccgtttttcgggatattgagttttggaaatcgtttggcttgacgctcaaatatgtattttataccgttgttcttatcaatgtcatcgcttttatgctggcttacgtgctgaccaaagggttaaaaggacagagcattttccgggcaggatttttcctgcccaaccttgtcggcggcattgtactcggttttatttggcagtttatcttcaacaacgtgcttgtctatttgggacaacatgccagcatacagtcgctcagcacgacttggctggctgatcctgacaaggcattctgggccctcgtgattgtaaccgtgtggcagaatgcaggttacatgatggtcatttatatcgcgggattgaccggtgtgccgaatgatattatggaggccgcaagcattgatggggcgaacagctggaccagactgcggaaaatggtattgcccttgatggttccttctttcatcgtatgtatattcttatccctgcagcgcggatttatggtctatgacgtgaaccttgcactcacgaaaggtgggccgttcagcagtactcaaatggtgtcgatgcatgtgtatgaaaaggcattcctttcccgtgattatggtgtggggcaggcagaagcattcgtgttgttcctgatggttgctctcatcactctgcttcaggtttattttagcaagaagttggaggtggaggcgtaatgacaagaaaaagaattgcttcctccgtgatcaaattcattgtgctgacagtcatactcatattgttcatcgtacctttcgtctttttgctgatcaattcgttcaaggaaaatagggccatcacctcaaatccgttatcgcttccagagagcttcagtatggtcaattatatgaatgcattcgataaaatgaattacatcgctgccttcaccaactcattggtcataacggtgttaagtgttctgtttatctcactgttcgcggcgatgacggctcattattttgtcagaaacaacaccaagttcaaccaatatacatttatgctgatggttgcatccatgatcattccattccaggctatcatgattccattggtgaaaatctacgggtcacttgatctgctgaacagtaagtggtcgttgatttacatgtatatcggttttggcagttcgctggccgtcttcatttatcatggttttgtaaagagtattccaaaggaactggaggaagcggcgctaattgacggttgcacgcggtttcagacattcttccggattgtgtttccggtactgatgcccacgactgccaccatttccattctcaatgtactgtggatctggaatgactttctgttgccttccctcattctggtcgatccggagcaaaggacacttccgttgtccacgtacaacttttatggaacctacacagtggattatggtccattgatggcaagtttggtactgacgatatttccgatcattatcatctatctgttcgcccagaagtatattattcagggtgttatgcaaggctcgattaaataactgcaggggggaggatgctttatcaaacacactagaacatatacgagagagcgtgcagatcaatttatttcccaatcgaagcatatgcttcggccagattatcggctgaactaccatttaatggctgaattgggctggatgaatgatccgaacggcttcattca

SEQ ID NO: 110 - DNA, 18 bp, Artificial Sequence
  Synthetic construct:  pmxDN primer
gagcttttctgaaggatg

SEQ ID NO: 111 - DNA, 19 bp, Artificial Sequence
  Synthetic construct:  pmxDN primer
ggtcgttacgtcgttgttc

What is claimed is:

1. An isolated gene cluster encoding a polymyxin synthetase comprising a PmxA polypeptide subunit, a PmxB polypeptide subunit and a PmxE polypeptide subunit.

2. The isolated gene cluster of claim 1, wherein the polymyxin synthetase is polymyxin B synthetase.

3. The isolated gene cluster of claim 2, wherein the PmxA polypeptide subunit has the amino acid sequence of SEQ ID NO: 13, PmxB polypeptide subunit has the amino acid sequence of SEQ ID NO: 14 and PmxE polypeptide subunit has the amino acid sequence of SEQ ID NO: 15.

4. The isolated gene cluster of claim 3, wherein the gene cluster comprises a pmxA gene having the nucleotide sequence of SEQ ID NO: 4, a pmxB gene having the nucleotides sequence of SEQ ID NO: 5 and a pmxE gene having the nucleotides sequence of SEQ ID NO: 6.

5. The isolated gene cluster of claim 1, wherein the polymyxin synthetase is polymyxin E synthetase.

6. The isolated gene cluster of claim 5, wherein the PmxA polypeptide subunit has the amino acid sequence of SEQ ID NO: 16, PmxB polypeptide subunit has the amino acid sequence of SEQ ID NO: 17 and PmxE polypeptide subunit has the amino acid sequence of SEQ ID NO: 18.

7. The isolated gene cluster of claim 6, wherein the gene cluster comprises a pmxA gene having the nucleotide sequence of SEQ ID NO: 7, a pmxB gene having the nucleotides sequence of SEQ ID NO: 8 and a pmxE gene having the nucleotides sequence of SEQ ID NO: 9.

8. The isolated gene cluster of claim 1, wherein the gene cluster comprises 8194th to 49233rd nucleotide of SEQ ID NO: 109.

9. The isolated gene cluster of claim 8, wherein the gene cluster has the nucleotide sequence of SEQ ID NO: 109.

10. A recombinant vector comprising the gene cluster of claim 1.

11. A transformed host cell comprising the recombinant vector of claim 10.

12. The transformed host cell of claim 11, wherein the host cell is *Bacillus* sp.

13. The transformed host cell of claim 12, wherein the *Bacillus* sp. is *Bacillus subtilis*.

14. The transformed host cell of claim 13, wherein the transformed host cell is *Bacillus subtilis* BSK6 deposited at Korean Collection for Type Cultures (KCTC) under Accession Number of KCTC11557BP.

15. A method for preparing polymyxin, said method comprising the steps of:
   (a) transforming a cell with the recombinant expression vector of claim 13 to produce a transformant;
   (b) culturing the transformant produced in step (a); and
   (c) isolating and purifying polymyxin from culture of the transformant.

16. The method of claim 15, wherein the polymyxin is polymyxin B and wherein said PmxA polypeptide subunit has the amino acid sequence set forth in SEQ ID NO:13, said PmxB polypeptide subunit has the amino acid sequence set forth in SEQ ID NO:14, and said PmxE polypeptide subunit has the amino acid sequence set forth in SEQ ID NO:15.

17. The method of claim 15, wherein the polymyxin is polymyxin E and wherein said PmxA polypeptide subunit has the amino acid sequence set forth in SEQ ID NO:16, said PmxB polypeptide subunit has the amino acid sequence set forth in SEQ ID NO:17, and said PmxE polypeptide subunit has the amino acid sequence set forth in SEQ ID NO:18.

* * * * *